United States Patent 9,958,448 (APTAMERS AND USES THEREOF) - sequence listing, part 2

SEQ ID NO: 10599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggatagcgacgctgttttactgggggccg

SEQ ID NO: 10600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggattattcatctccgctttcgcctccac

SEQ ID NO: 10601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggatttaatggaactatcaattgtccgtt

SEQ ID NO: 10602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggatttgaatggatggtttcctcttacgc

SEQ ID NO: 10603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcaaagattatgggggtgctcgatcatc

SEQ ID NO: 10604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcaagcagctgattctcgtgcactgtgt

SEQ ID NO: 10605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcaatcaccgcgttccaggtgggggcat

SEQ ID NO: 10606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcaatgtttgaccgccccctgagtgcca

SEQ ID NO: 10607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcatgacagtggcgggatcaatgccgca

SEQ ID NO: 10608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccaacacaagacgtgctattgcctgag

SEQ ID NO: 10609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccccttgtatccgttacgttatgcgtt

SEQ ID NO: 10610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcccgacgcagaacaaggacattgggcg

SEQ ID NO: 10611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcccgcaatgcgaagtcgtcccgattgg

SEQ ID NO: 10612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccctgttaactagcgcttctgcgacgc

SEQ ID NO: 10613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccggataccatcaggtctttgtccttg

SEQ ID NO: 10614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccggttgtgcaggtggcagagcttgaa

SEQ ID NO: 10615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggccggtttcttcattgggatcgtcgagt

SEQ ID NO: 10616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcgattaaccgtgctctggcgggatcct

SEQ ID NO: 10617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcggacatcctccgtttaggtgggggcg

SEQ ID NO: 10618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcggggctagggcggagagaccgcggcg

SEQ ID NO: 10619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcgtcggtaaggcgagaggtctgcttgt

SEQ ID NO: 10620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcgtctgatgggttgttctatggccggc

SEQ ID NO: 10621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggcgtgtggcgaagtgtgtcaaccggtgt

SEQ ID NO: 10622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggctgatgctcctagcgcgaataccggcc

SEQ ID NO: 10623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggctggtcttggtttgtcactgaatacac

SEQ ID NO: 10624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggctgtcggatacattattctggatcttg

SEQ ID NO: 10625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggaaatggatcgttcctgggtggtccct

SEQ ID NO: 10626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggaatgttgccatcattcgaagccgctg

SEQ ID NO: 10627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggactcccacttccgatgccatatgatg

SEQ ID NO: 10628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggagggtaaagcgtggcccctattcttg

SEQ ID NO: 10629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggaggttccctgcgaatgatgattagtc

SEQ ID NO: 10630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggcaacgagttaacaatgtgtcccttgg

SEQ ID NO: 10631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggcacatgcgtctgtgtagcggttggtt

SEQ ID NO: 10632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccaaggatcggttctcctgcttgcga

SEQ ID NO: 10633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccacacggaatctaaaactagtgaac

SEQ ID NO: 10634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccacgggtgtcactagccgagcccat

SEQ ID NO: 10635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccaggatgttcgatgggtgattgtgg

SEQ ID NO: 10636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccgtagcggtctttcagggcaatgcc

SEQ ID NO: 10637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccgtgggcgcgcggtcgatgttgcga

SEQ ID NO: 10638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggcctctctggactgggtaggctagtat

SEQ ID NO: 10639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccttaagctatcatttcactcgctcg

SEQ ID NO: 10640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggccttgtgcactgtaccgtggggtttt

SEQ ID NO: 10641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggcgggctgcacgggatcaagacaccgt

SEQ ID NO: 10642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggctacaacggatttgagtgcgcttttc

SEQ ID NO: 10643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggcttatggatatacaggaagctctgta

SEQ ID NO: 10644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggggaaccggtttctaggtcgtctagggt

SEQ ID NO: 10645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggggagcatgcctgggggtcactggtagc

SEQ ID NO: 10646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggggagcattacatgttgggagttcaacg

SEQ ID NO: 10647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggggttaagcgacgcttcgttgggggtt

SEQ ID NO: 10648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggggtcgactggcggaactcgactatggg

SEQ ID NO: 10649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggtctcccgtaagcagcagggctcccac

SEQ ID NO: 10650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggtgaacaacaaactgcgtctgttctcg

SEQ ID NO: 10651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggtggtcatacaggggaatgatcggagc

SEQ ID NO: 10652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggttgcatccgtcggaggattcggccgg

SEQ ID NO: 10653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggttggatacatacaataaattgaaatt

SEQ ID NO: 10654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggtttacttgaggacctggagaacaact

SEQ ID NO: 10655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgggtttcacgctatgcgacatgattgaca

SEQ ID NO: 10656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtaatcactgggttaccgaatagggccc

SEQ ID NO: 10657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtagcctcgcgcagacacagcaatgagt

SEQ ID NO: 10658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtaggacctcgctgtcgtgtcgctcagt

SEQ ID NO: 10659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtagtgatataactcactctgcatctgg

SEQ ID NO: 10660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtagtttgtcctgaatgtgcatttggtg

SEQ ID NO: 10661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtattcggctgtattaggttacttactt

SEQ ID NO: 10662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtcaacaaactgcgtgttcctttatgtc

SEQ ID NO: 10663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtccatatacattggagggagttcacga

SEQ ID NO: 10664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtctcgtcggatgtgtcgtcatgacgtt

SEQ ID NO: 10665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtgacggatgccattagcttgagccgtt

SEQ ID NO: 10666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtgacgtgctgggtactcgaccgccccg

SEQ ID NO: 10667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtgactgtttaatgaggcactgcttggt

SEQ ID NO: 10668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtgcgcactcagaacgtcgtggtcgcgc

SEQ ID NO: 10669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtggacaagtcccagttaaacgctcagg

SEQ ID NO: 10670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtgtctggcgtttggtcactggcgcggg

SEQ ID NO: 10671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttacccagttattctcaccgttggcac

SEQ ID NO: 10672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttacgcgtgtgacccggttgtacggag

SEQ ID NO: 10673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttatgtactgcgtagtgagatttgcgt

SEQ ID NO: 10674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttccgtccgactagcatcccggcgtta

SEQ ID NO: 10675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttcgaggtgtgctcctggtacttagat

SEQ ID NO: 10676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttctcattgtggatggccttgcatcat

SEQ ID NO: 10677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttctgcaacgtggtgggctcttgccct

SEQ ID NO: 10678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtttacatctagcaggttgtgttctatc

SEQ ID NO: 10679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggtttccggatagtcgctttgcttttgat

SEQ ID NO: 10680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcggttttatcggaccggcattagacgcgat

SEQ ID NO: 10681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtaaccgattattttctggcagctctggc

SEQ ID NO: 10682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtacaagcttatccgaacagggacaggga

SEQ ID NO: 10683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtacacaagattacagggagcatctctgt

SEQ ID NO: 10684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtacgtcgctaggaaccgtatttctacgg

SEQ ID NO: 10685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtactgcgtggaacagtcttatgccaggc

SEQ ID NO: 10686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtacttattccttataaaatctgctctcg

SEQ ID NO: 10687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtagctgttacgattttgcttctaacctt

SEQ ID NO: 10688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtagttagacggctattcatcctggggcg

SEQ ID NO: 10689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtatgccggtcacgcgtagtcggagttta

SEQ ID NO: 10690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtattcaactgtgcgtgtggctttgcgta

SEQ ID NO: 10691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcaaaatttaccggtatcacatttgggg

SEQ ID NO: 10692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcaccgcggaagggttcgcatcttcatc

SEQ ID NO: 10693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcagtcgcacgggggtcttatgtactgg

SEQ ID NO: 10694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcagtggcgggggtgtcatcaggagggg

SEQ ID NO: 10695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcatattgtcgcgcagagtgtcctctat

SEQ ID NO: 10696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtccgaggagttccgagccacactcgcgg

SEQ ID NO: 10697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtccggaatgcgccgcggccaggtctgtc

SEQ ID NO: 10698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtccgttaccgcacacacatcgagcacca

SEQ ID NO: 10699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcctgtcaaggcttacggttagtatgct

SEQ ID NO: 10700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcgcgcccgagtttggtcctacaaagcc

SEQ ID NO: 10701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcggtagtacatcagcttatgccaccgc

SEQ ID NO: 10702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtcggttcacctcttaaatggtcgtggcg

SEQ ID NO: 10703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctaattaaagtaaacttagcaggcgcg

SEQ ID NO: 10704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctctcgttaaacgaccggggggcgtag

SEQ ID NO: 10705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctcttataaccccggagtgaggcgaaa

SEQ ID NO: 10706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctgcagatcgaagggtaggcggccgat

SEQ ID NO: 10707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctgccgtagctcggactctgctagtta

SEQ ID NO: 10708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctggcttgcaagagaggtttcagctgg

SEQ ID NO: 10709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctggtggggcttggaccgattcgggat

SEQ ID NO: 10710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtctgttgaccgttactatctccgcccgg

SEQ ID NO: 10711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgagcggggatattcgagatgcggtagg

SEQ ID NO: 10712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgagggtctggaactccccactaggtgg

SEQ ID NO: 10713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcacgcgaggtctccttcagccctgct

SEQ ID NO: 10714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcagaacgggtgaggcactacagctcc

SEQ ID NO: 10715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcagtgaacggaggggatcgaaatctg

SEQ ID NO: 10716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcagtggtcgtgagcgacgcgaagttt

SEQ ID NO: 10717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcatggggggcgttatggttcggatgt

SEQ ID NO: 10718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcccgtaggagcggatgatgacgccga

SEQ ID NO: 10719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcgggaagctgtggcgcgctgtagctg

SEQ ID NO: 10720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcgttgaaaggaatccgctggccggtg

SEQ ID NO: 10721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgctcaggcaatacgccccgttacgatc

SEQ ID NO: 10722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgcttaatagggtaaacgcgggtggacc

SEQ ID NO: 10723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtggattataaggacttcaatacccccgc

SEQ ID NO: 10724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtggcgctagtcggactcacagtgtgctg

SEQ ID NO: 10725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgggcgcgaagttgaacgactttccttt

SEQ ID NO: 10726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtggggtgttgcagtccccgtcctgttat

SEQ ID NO: 10727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtggttaaggcgtccgtcgcggtcgggca

SEQ ID NO: 10728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgtaatttcgtcgctttagttgagcaac

SEQ ID NO: 10729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgtgaacgtgcaccccctaccccatcac

SEQ ID NO: 10730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgtgcctgttcgatatcgcggttcacta

SEQ ID NO: 10731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgtgctgatcgatacgccgaggctcggg

SEQ ID NO: 10732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtgtgtcggacaggatcttgtgtgctgtt

SEQ ID NO: 10733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttacgatgtgtaacacatcttgggctct

SEQ ID NO: 10734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttagcctttaggattagcgctgggggcc

SEQ ID NO: 10735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttagcggacgaggtgggaaatttcggag

SEQ ID NO: 10736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttatcgcccgaattgcaggtcttgcgca

SEQ ID NO: 10737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttcgatgtacgctgtttgatagtcttat

SEQ ID NO: 10738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttcggtgaagagttctctaccaaggcct

SEQ ID NO: 10739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttctcgaatccgccaagaacgggctgtt

SEQ ID NO: 10740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttgatgacatcttcagagttggtgcatc

SEQ ID NO: 10741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttgggattgacatgtacgttttcatggt

SEQ ID NO: 10742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtttagaccattaaaacgcaatcacttcc

SEQ ID NO: 10743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgtttgtgtttttcaacagagtgtgtatgg

SEQ ID NO: 10744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttttagacatctgaatgctagatctgta

SEQ ID NO: 10745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcgttttgaaagcgtaaaatctgatatactg

SEQ ID NO: 10746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaacatttcccgggcggttgctcgagagc

SEQ ID NO: 10747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaaggtgtcgcccccggcctcaacactgg

SEQ ID NO: 10748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaagtttgaacaggtgtgtagtatgtcgg

SEQ ID NO: 10749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaatgtcgggggtgagtaagcaacctgcg

SEQ ID NO: 10750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctacctcgccctggataagttgcctcaacg

SEQ ID NO: 10751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctacggatcttggtttgagttaataggaac

SEQ ID NO: 10752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctacgtcacagcgggcctggagaggatggg

SEQ ID NO: 10753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctactcgccgaatacctgtccgcaaaggtt

SEQ ID NO: 10754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagacgggacatgggcgtattaatcgggg

SEQ ID NO: 10755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagacggttcaagggcgttcgagtgctgg

SEQ ID NO: 10756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagagggtaggggcgtacattctaaggac

SEQ ID NO: 10757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagagggtgatgggagcgcactgctcatt

SEQ ID NO: 10758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagccgataaaaccgcgggggaacgttag

SEQ ID NO: 10759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagcggcgtgtcatcactgatgcggttac

SEQ ID NO: 10760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagctatgtcactggctgttacccggtga

SEQ ID NO: 10761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaggacggggtaaatcgactcatccgtgc

SEQ ID NO: 10762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaggggtggagttagcttcttggtctgga

SEQ ID NO: 10763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaggtagcgcgctaatctgtagcttagta

SEQ ID NO: 10764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctaggttatagggctaaaatcgaacctgtt

SEQ ID NO: 10765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctagtaggtaaaagttggtatcacggttgg

SEQ ID NO: 10766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctatcatgtctacatatcccctctcggtta

SEQ ID NO: 10767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctatcgccgagcattgacagttagctccta

SEQ ID NO: 10768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctatcgcttctcatttagggatcttggcaa

SEQ ID NO: 10769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctatgcggtcactttaataatatttgatga

SEQ ID NO: 10770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctattaagagctcgccttctgactcgtgct

SEQ ID NO: 10771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctattctcggtgtttgacccccccgatcac

SEQ ID NO: 10772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcaagaccaatgcggattgtccggtctcc

SEQ ID NO: 10773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcacccatctttaccccattcgggctgca

SEQ ID NO: 10774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcaccgaacacatatggcctgttggttcc

SEQ ID NO: 10775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcacgtcattgggttccggaagggcgtcg

SEQ ID NO: 10776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcactttcggatacgtcgcttctggttgc

SEQ ID NO: 10777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcagagtctcgccgtggtagtcaacccga

SEQ ID NO: 10778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcagatttccggatcgagctcaaagcacg

SEQ ID NO: 10779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcagtcatgcgagctagtaagaaaaatcg

SEQ ID NO: 10780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcatacacgttttggcggtacgacgcagg

SEQ ID NO: 10781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcatcttaataagtagcatcaaatcggcg

SEQ ID NO: 10782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcatcttgccgtacgccgacccgagcaac

SEQ ID NO: 10783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcccacgagattccgtcggcttgtgaatc

SEQ ID NO: 10784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcccacgggcgtaacaaaagttcaaccac

SEQ ID NO: 10785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcccgtgacagggttacatgaataaacat

SEQ ID NO: 10786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccctgttcatgttcgaactttacaaacg

SEQ ID NO: 10787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccgcattcggtcgctccccagtggaatt

SEQ ID NO: 10788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccgctgtctcacatcgtgctgcaggacg

SEQ ID NO: 10789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccggattggcctttctagcgttggctgg

SEQ ID NO: 10790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccgggactggccaacctctcagtgttag

SEQ ID NO: 10791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctccgtttacgtggtactagaatctgcatg

SEQ ID NO: 10792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcctgccaacgtaagctcggagtcggttg

SEQ ID NO: 10793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcctgtggagtttcatctcttctgatcgc

SEQ ID NO: 10794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgacttaggcggaaccgtgaattagccc

SEQ ID NO: 10795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgatctattcgactctggccattaaaga

SEQ ID NO: 10796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgattttgcagctttcatccgtgtgaag

SEQ ID NO: 10797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgcatttctactggtcttgtctattgct

SEQ ID NO: 10798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgcctagatgtagctccaggattatgtg

SEQ ID NO: 10799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgcgtttatggacaagcaggagcacacg

SEQ ID NO: 10800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcggatcagtcctctagactagtaatggc

SEQ ID NO: 10801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcggcggtgctttttctatcttctttggc

SEQ ID NO: 10802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcggggctctgttatttgcttgccagtgt

SEQ ID NO: 10803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcggggcttgttaagatcgcccttccttg

SEQ ID NO: 10804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcggttttgacgatcgcccgtccgcgttt

SEQ ID NO: 10805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgtataaatatccgccttactcttgatc

SEQ ID NO: 10806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcgtcatctgtacgttagctcacggatta

SEQ ID NO: 10807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctctccagaatgcccgcgctgtccaacccg

SEQ ID NO: 10808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctctcccacccagttgtaatcactcaaggc

SEQ ID NO: 10809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctctgcatttccgaaccccgccatgagtcc

SEQ ID NO: 10810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctctgcggccgacatagtgttgagagctca

SEQ ID NO: 10811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctcttaccgacggcgcttaaatacatggtc

SEQ ID NO: 10812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctctttacgaaccgacgtttttatgttggc

SEQ ID NO: 10813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgacacataagttcgtgtattttgaatga

SEQ ID NO: 10814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgagtgcccgatgagcggcttcacgttga

SEQ ID NO: 10815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgagtgtcaatcccctgttttcgccaaga

SEQ ID NO: 10816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgatactttccccggcatatgaatggtgt

SEQ ID NO: 10817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgatgacagtcttgacttggcagttcgtg

SEQ ID NO: 10818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgattaatacaactagctcgggcagagac

SEQ ID NO: 10819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgattcacataaggtatatgagttctacg

SEQ ID NO: 10820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcaatgcgtgcattgcggaaaatggtgt

SEQ ID NO: 10821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcagaccggattggccttgagtcccgcg

SEQ ID NO: 10822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcagctacatgtgccgaactactcgaat

SEQ ID NO: 10823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcatgggtttcggtaccaacgtgattat

SEQ ID NO: 10824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcccgtttgatcgacgtgtttgtttctg

SEQ ID NO: 10825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcccttaatattcgggcgtttcgtgagc

SEQ ID NO: 10826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcctaactcgttctgatatgtcggtatt

SEQ ID NO: 10827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcctcattaatactcactacatcgttat

SEQ ID NO: 10828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcctctcccccacagccacgcgatctgc

SEQ ID NO: 10829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcgccacatcgtctcgaggagatggcct

SEQ ID NO: 10830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcggccggtaacccatatgtggtgcggt

SEQ ID NO: 10831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcggcgcatatggtgtctgtggacagct

SEQ ID NO: 10832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgcggtgtagcggagaagcgccgtgggag

SEQ ID NO: 10833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgctctctccccattttgtccctggttcc

SEQ ID NO: 10834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggaaagttgcctgcattattacggctct

SEQ ID NO: 10835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggaacgtgtatcccgggccacctcttaa

SEQ ID NO: 10836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggaccacccccagccgccctgcgactcg

SEQ ID NO: 10837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggagttacgatgtgcggaagggaaatcc

SEQ ID NO: 10838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggatcagtccgtttgcgatagcggctgc

SEQ ID NO: 10839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggatctatcactttacgcacagttccta

SEQ ID NO: 10840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggcaactgctaaacggggagctgacggt

SEQ ID NO: 10841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggccgattacacgctcgcgaccttcgtc

SEQ ID NO: 10842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggcgctactatgtgacttgtgcttttat

SEQ ID NO: 10843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggcggtttgttgaagtgaatcggctagc

SEQ ID NO: 10844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggcgcggtggaagtgatgcgccggcga

SEQ ID NO: 10845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggcggatgaagctacggaggtatcgcg

SEQ ID NO: 10846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggcggtagacgagaagttgcaggtaat

SEQ ID NO: 10847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggctttccgaccggattcccggtgttg

SEQ ID NO: 10848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggggaacgctgagcaatacatatagcac

SEQ ID NO: 10849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggggcgtgattgtgcctggatggatcgg

SEQ ID NO: 10850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggggggccggtaaagaggctagacgaaa

SEQ ID NO: 10851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggttcaatgaacacttcccttaatgta

SEQ ID NO: 10852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgggtttccagacgactgccttgggttcc

SEQ ID NO: 10853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtaaaggggcgggggacaggatttgat

SEQ ID NO: 10854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtactgggtcttcggtggtagtacgct

SEQ ID NO: 10855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtgactcagagtgcccaagttaggatg

SEQ ID NO: 10856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtgccgtctacagtggactaatggttc

SEQ ID NO: 10857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtggagccactcacgaacgtgatacca

SEQ ID NO: 10858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctggtttcacggagaactatagatcagcaa

SEQ ID NO: 10859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtaaaaaatgcgtattccagtgcaacgg

SEQ ID NO: 10860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtacgtcgctgtaatcttgtactcaccg

SEQ ID NO: 10861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtagacagtcgagcgccaccttacttgg

SEQ ID NO: 10862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtagcgcggacttaccctgaactcttag

SEQ ID NO: 10863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtcacttatgccagtcagtttggttcac

SEQ ID NO: 10864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtctctactctgttgcagcaggtatggt

SEQ ID NO: 10865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtgcatcttccctttcctcggggacaca

SEQ ID NO: 10866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtgcatgttgcgccctgagcatcgatcc

SEQ ID NO: 10867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtggagagcgcagaaaggtatttcgccg

SEQ ID NO: 10868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgtgtagaggacccgtgtatgttggcgcg

SEQ ID NO: 10869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctgttcctccccacggtgtcggaagaggtg

SEQ ID NO: 10870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttaaacgtacggcaatctgcctcttagct

SEQ ID NO: 10871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttaacctacatatctagtggaatatctcg

SEQ ID NO: 10872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttacacgtgtcgcagccgccttgtgctgg

SEQ ID NO: 10873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttacggacgcctcggagaagtcttcatct

SEQ ID NO: 10874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttacgtgctcactcactcctatcccggcg

SEQ ID NO: 10875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttagcaacctcggtacctggggggcaggc

SEQ ID NO: 10876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttagtacgttgaatagacgcggcggtggg

SEQ ID NO: 10877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcaacctcgggggctactgtacaacggc

SEQ ID NO: 10878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcacgtttatgaccgcgcttctttcggg

SEQ ID NO: 10879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcagagtgactgggccagcctcgggtgt

SEQ ID NO: 10880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcagcaccaatacgcctggcgtccgtgc

SEQ ID NO: 10881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttccaaatcgcctcaacagaagtactctt

SEQ ID NO: 10882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttccaactgcgcaaaccaccaatgagtcc

SEQ ID NO: 10883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttccggatttgtgcaccgcttaatcgcgt

SEQ ID NO: 10884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcgagaccgatagggcactttggcaact

SEQ ID NO: 10885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcgattcacctcattattcatggttcgt

SEQ ID NO: 10886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcgcgttcatccgagacagtgaccttta

SEQ ID NO: 10887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcggcctcgccggtgcgtctcttaggca

SEQ ID NO: 10888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcgtcaagtgcgcccacagtactcgact

SEQ ID NO: 10889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttctatttgcggctctcaggcccgaacgt

SEQ ID NO: 10890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttctcgcagtgagctaattcatccgtgcg

SEQ ID NO: 10891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttctcgtagccacccagattcgtgtcatt

SEQ ID NO: 10892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttcttctttgagctgatcccctgtcgccg

SEQ ID NO: 10893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgaggtagctaaccttctatgggcaagc

SEQ ID NO: 10894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgatggtctcgttgcggttcttcatccg

SEQ ID NO: 10895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgcaatgtccttctcaagacggatccat

SEQ ID NO: 10896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgccacgatgctgcggtggtagttcatc

SEQ ID NO: 10897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgcggtggaggtgcgcgccagtgacagt

SEQ ID NO: 10898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgcgtaacaagctgtggggtcctttatt

SEQ ID NO: 10899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttggcccttcgcaattcgtaaaatctacg

SEQ ID NO: 10900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttggctcttgtcctccgtgtttcctggtc

SEQ ID NO: 10901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttggtggtgctaacatcgcgtgctgctct

SEQ ID NO: 10902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgtacgttcatctcgtctagcgccccca

SEQ ID NO: 10903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgtagatcggcaactcgtgcgactggtg

SEQ ID NO: 10904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atcttgtccgcgatacgcttgtcagggtcatg

SEQ ID NO: 10905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttaagaccgttcggactacgcccgtgca

SEQ ID NO: 10906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttaagtggcaaacacattacccgggcga

SEQ ID NO: 10907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttcaggtttaataaccttcctaacactc

SEQ ID NO: 10908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttctcggctttttcagggactcggcgtg

SEQ ID NO: 10909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttgagggaattcattgagcttttgtctt

SEQ ID NO: 10910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttgctctgttgttagtggcctgcaaagg

SEQ ID NO: 10911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttggtttctttgtgactgtttagcaagt

SEQ ID NO: 10912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttgtaaccaagcgacgaatctggccatg

SEQ ID NO: 10913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atctttgtcccaggcatctcatcagtaaattc

SEQ ID NO: 10914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaaccccaggcgtccgacccgcctaatcc

SEQ ID NO: 10915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaacgtgaactatcaatctgcaatcgcgt

SEQ ID NO: 10916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaagcagccggggatgatcagggcaacgc

SEQ ID NO: 10917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaaggaatcactcggcttagctgcggcgc

SEQ ID NO: 10918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaagtcggctccggtttggggggtagtcg

SEQ ID NO: 10919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaagtggagctggcagccgacaaagggac

SEQ ID NO: 10920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaattggtgtaccggtagggttcgcccta

SEQ ID NO: 10921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaatttgttctctggctgctatgcttacg

SEQ ID NO: 10922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaacagtgacaggtgcatacaacaatccga

SEQ ID NO: 10923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaacagttaaccaacgaaaagggccgggct

SEQ ID NO: 10924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaacatggtcaaggtttgactgtattgccg

SEQ ID NO: 10925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaacgttccatcacatattgcgaggtgtct

SEQ ID NO: 10926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaactccccgtacgttaatggggcgttgtc

SEQ ID NO: 10927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaactgctagccccggttatggcttgtcat

SEQ ID NO: 10928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaactgtcgcgagaaagaactgactcccgt

SEQ ID NO: 10929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagacgcaaatgacagtgctgacccgggc

SEQ ID NO: 10930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagagcggggttcctacctctgatcccga

SEQ ID NO: 10931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagagtaaaccagcatgtcaatccatatg

SEQ ID NO: 10932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagcatctgccgggttgtgcctagtgggc

SEQ ID NO: 10933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagcctaatagaaacctcggaacgccata

SEQ ID NO: 10934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagcggggatacacaccgtttttccctcc

SEQ ID NO: 10935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagctagatgggcgggaggacattgaggg

SEQ ID NO: 10936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaggaacagtaacgcgcttgtgtttgata

SEQ ID NO: 10937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaggagcggccgcttaggcacgactttgt

SEQ ID NO: 10938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaggcaagaggcatatctagcgagaaggc

SEQ ID NO: 10939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaagggtatggggtcggatctaccatatgt

SEQ ID NO: 10940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaaggtgagcagagtctggttgaccggtac

SEQ ID NO: 10941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaatccgacgtcgccggtgcggggtgttgt

SEQ ID NO: 10942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaatcttagcaaatggcttgctacagctta

SEQ ID NO: 10943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaatggaaatatatgttgcacgttgaagtt

SEQ ID NO: 10944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaatgggacgactgcgtagggggtagagcc

SEQ ID NO: 10945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaattagggttctgcattttctccgtgcac

SEQ ID NO: 10946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaattctatcgacgagttaggtacttcatt

SEQ ID NO: 10947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaattggtgacgataggcgtggcacggaat

SEQ ID NO: 10948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacaaactgtctccatccccatatgctttg

SEQ ID NO: 10949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacaattcgtaggtcgcgaatgctttgaag

SEQ ID NO: 10950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacaccgcgcacccttacgtgggaaggcgg

SEQ ID NO: 10951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacagcctagccccatacccttggtgctta

SEQ ID NO: 10952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacagctaacggcagaagcgggtcttatta

SEQ ID NO: 10953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacaggcatctggttgatctctccctttgc

SEQ ID NO: 10954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacaggggctgtggcgaggtattacctcga

SEQ ID NO: 10955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacagggggggctatagtggcaccaaactg

SEQ ID NO: 10956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacattaagtaccacgtgtgtacagcttgg

SEQ ID NO: 10957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccaaacctcaccatggatcccctccgcc

SEQ ID NO: 10958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccaattctgccgtgtgtgactgtggtcg

SEQ ID NO: 10959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccacgaagtgtttacgttttggcggtct

SEQ ID NO: 10960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccagaagcactcagctctacggggtgat

SEQ ID NO: 10961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccataccttcaatctcacgatgacatgc

SEQ ID NO: 10962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacccaactaggctggaggcgacaaggact

SEQ ID NO: 10963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacccgacaacacgacgtccagcgtattac

SEQ ID NO: 10964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacccgtaaccgtaacgcgaggccatccgg

SEQ ID NO: 10965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccctaacgttatgctcataacccggatc

SEQ ID NO: 10966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccgggcccgctctcttaattctcctcgc

SEQ ID NO: 10967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccggggcgttttatgtggaaccatatac

SEQ ID NO: 10968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccgttccgagtccggtagctcccgctcc

SEQ ID NO: 10969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacctggtccatggcggagctacgccaatt

SEQ ID NO: 10970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacctgttacgggttcatgggctgttttcc

SEQ ID NO: 10971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaccttgagagatgtatacgggcagtcctg

SEQ ID NO: 10972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgaccgaatagtgtgtccgtgaaagtgt

SEQ ID NO: 10973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgagcaccagcctatcctaggacggata

SEQ ID NO: 10974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgatgttggttggttcataagcctggtc

SEQ ID NO: 10975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgcctacatctattaaatgtgacacggc

SEQ ID NO: 10976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgctatttagggacattagtctcaatgc

SEQ ID NO: 10977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgctgcggtttttctctgcagggatcac

SEQ ID NO: 10978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgcttcgggcggcagtcgcggaatgaca

SEQ ID NO: 10979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacggcccattggatccagtgagtcctttc

SEQ ID NO: 10980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgggatttccggcacctagtttctgctg

SEQ ID NO: 10981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacggtcggcgtcgatatcttctggctgat

SEQ ID NO: 10982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgttcgtcctcacatcgcatgctttgat

SEQ ID NO: 10983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacgttgtggctgttaattggtccgctggt

SEQ ID NO: 10984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactaacgcccaacagacctccgggacgcg

SEQ ID NO: 10985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactagcgggatatcgagttttcttcaacg

SEQ ID NO: 10986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactagcggttcgaccgtgcactctccctt

SEQ ID NO: 10987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactcagcgatgacctcattatttctgagc

SEQ ID NO: 10988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactcgatctgtttgcatcaaaaatcctcg

SEQ ID NO: 10989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactcgcctgtatccgtgtgctagttcttc

SEQ ID NO: 10990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactctctacgcctacattattcgtgcggg

SEQ ID NO: 10991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactggtcgaagccaaatcgtagggtggct

SEQ ID NO: 10992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgactgtgattactgttcgacgttgatggtg

SEQ ID NO: 10993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgacttagccatgattccttcgggaccgagg

SEQ ID NO: 10994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagaaaatacaatgaactcttgtgggtagg

SEQ ID NO: 10995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagaccagtgatcgtcactagtttagccac

SEQ ID NO: 10996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagacgagtcggtgaggttcagtgggtttg

SEQ ID NO: 10997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagacgtatcacgaaccttctgttgtcctc

SEQ ID NO: 10998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagactaggacgtggtgcagagagttagga

SEQ ID NO: 10999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagactggtatcgctcctctcgtccgtggc

SEQ ID NO: 11000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagatacatccagtctcacacggctttggt

SEQ ID NO: 11001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagatcgggcatgcatgggtaacttcgtcg

SEQ ID NO: 11002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagatggtcggggtaatagtcgactactgc

SEQ ID NO: 11003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagcacggcgttaacctcttaatggcgaca

SEQ ID NO: 11004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagcagatggggctggtgtcaggacgaata

SEQ ID NO: 11005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagccgatgacccactgtttcgcctacctt

SEQ ID NO: 11006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagccggatcccataatctcccaattgggc

SEQ ID NO: 11007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagccgtgcgtccaaccataactgtcgcgc

SEQ ID NO: 11008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagcgctatcgaatcactgggaatcgctcc

SEQ ID NO: 11009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagctttgcgatgtcagggagtggctgggg

SEQ ID NO: 11010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggacagtctggttgaatgccattgagga

SEQ ID NO: 11011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggatctgccctagtacacaacccggatc

SEQ ID NO: 11012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggcccatttgcgcacgctaggtcacgtc

SEQ ID NO: 11013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggcgatagctaagctgccttcacggaat

SEQ ID NO: 11014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggcggcgaggtcaggtattacggtgtca

SEQ ID NO: 11015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggctgttctaggttagcgcggtttacac

SEQ ID NO: 11016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggtactgagcctggcaaggtagcgggca

SEQ ID NO: 11017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgaggtgacgatgtgcgtccaagctttgacg

SEQ ID NO: 11018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtaaactcgtggtcctttaacggtatct

SEQ ID NO: 11019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtaagcggtactcttgttctcgcggcta

SEQ ID NO: 11020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtagtgagaggcctcgatttgcagtgga

SEQ ID NO: 11021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtccgtgctagtaccctgattcccatag

SEQ ID NO: 11022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtctatccgcaggcctcaggcagcgtag

SEQ ID NO: 11023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtgatttggacgggggtgccggctgaat

SEQ ID NO: 11024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgagtgtagtctccgatgcgttcggctcgta

SEQ ID NO: 11025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgataagcactcctaatatcgtttccggtct

SEQ ID NO: 11026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatactggctttcttgtgatagctattgct

SEQ ID NO: 11027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatagctcaatgcatttcctctaccttaac

SEQ ID NO: 11028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgataggtgcatggcatgaaagacagaggtg

SEQ ID NO: 11029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatagtaccggtcgaatgcaactgaggctt

SEQ ID NO: 11030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatagttaggcggctagtgactatatcatc

SEQ ID NO: 11031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatataatttagtactgcctgaatgttgtg

SEQ ID NO: 11032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatatcgtaaccgctaggcaactatggcca

SEQ ID NO: 11033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatatgcgtttcaagagtttctactcgtac

SEQ ID NO: 11034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatatggaccctagttcgaacttctaggat

SEQ ID NO: 11035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcaaagtatttgttgttcgaccactata

SEQ ID NO: 11036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcaagcacttttgttatgcgcgacttta

SEQ ID NO: 11037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcagaagacacgggcaaatcctgacagc

SEQ ID NO: 11038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcattgacttaggttctcggtcaatcta

SEQ ID NO: 11039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcattgcagtttggcgcgacgcgttggg

SEQ ID NO: 11040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatccgcctgggctggacaaggcaattgcg

SEQ ID NO: 11041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatccgctctggcggcgcctgaaaccggat

SEQ ID NO: 11042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatccgtgtgcattatgcatttgtaggagt

SEQ ID NO: 11043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcgcgcctgcgtcgttgcagcgaaacta

SEQ ID NO: 11044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcggggtggctcacgttcagttgtcacg

SEQ ID NO: 11045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatcgtacaattcctatcattcgtggtcca

SEQ ID NO: 11046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatctaccattcgtcactatcaccaccagc

SEQ ID NO: 11047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatctagagattacgtgggagggctgatta

SEQ ID NO: 11048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatctccaatttgaactttgacagggaccc

SEQ ID NO: 11049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatctggtgaaacagcatttattgaagcgt

SEQ ID NO: 11050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgaacgacaatgtgtgagaggagggcgt

SEQ ID NO: 11051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgaattgtgaacacgcttactgattcgt

SEQ ID NO: 11052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgccccgtccccctggtctagacctggt

SEQ ID NO: 11053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgccgtcgattattattaccggccgggg

SEQ ID NO: 11054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgcctcgtacaccccacggtcttgcagc

SEQ ID NO: 11055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgcgtcccccacgggcttcatgtagcgt

SEQ ID NO: 11056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgcgtgaaagtgttaggcacttggggtc

SEQ ID NO: 11057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgcgttcggtatccaaactcgttcgctg

SEQ ID NO: 11058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgctgactagacagggtggttttgtggc

SEQ ID NO: 11059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatggaaggcgagtacatgacactttgtcg

SEQ ID NO: 11060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgggggacatccaccagcacgcttaaac

SEQ ID NO: 11061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatggggtcagggccacagctgcactatgg

SEQ ID NO: 11062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatggtagctagaggtactggcctcacgtt

SEQ ID NO: 11063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatggtatcacctcattcagttattaggag

SEQ ID NO: 11064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgtacggcggagcaaggtccgggagaag

SEQ ID NO: 11065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgtctgaacttgggaaaatcatctggcg

SEQ ID NO: 11066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatgttttctgaggtcactagggctggatg

SEQ ID NO: 11067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattactcgttgggtagcccgctactttcg

SEQ ID NO: 11068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattcaacgccgcggtgtttcgtgacggcc

SEQ ID NO: 11069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattcagaggggtaaggacggcggtttgtc

SEQ ID NO: 11070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattcctccggggactgttcctccggcggt

SEQ ID NO: 11071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattccttcttcgtaactggaaagtctcgt

SEQ ID NO: 11072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattctctgctcaacagatgctcataagta

SEQ ID NO: 11073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattctttgatcgggtgttaggaagcgcta

SEQ ID NO: 11074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattgctcggttaatacgttcgcacgggag

SEQ ID NO: 11075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattgtgttgaggtcagttgtgtaatccga

SEQ ID NO: 11076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgatttgtctaactatggtcctggtggtcac

SEQ ID NO: 11077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgattttgcgtcaacttaaacgtcggaagga

SEQ ID NO: 11078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaaaccactaggatgtccggtgtccgagc

SEQ ID NO: 11079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaaactgtggactttaggctggtaggggc

SEQ ID NO: 11080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaaaggcgccgaattctcgcaggcatcta

SEQ ID NO: 11081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaaaggggccttgcaccgtgggcctggtt

SEQ ID NO: 11082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaacgcaatttatgaaaaaagtcgaccaa

SEQ ID NO: 11083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaacgttttatgctttgtgttttggcctc

SEQ ID NO: 11084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaactaaacactgaacgtcgttggtctcg

SEQ ID NO: 11085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaactgcaacttgagctcgcgtcgtatcc

SEQ ID NO: 11086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaactgggcagtgcaactgcttgggggtg

SEQ ID NO: 11087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaacttgctttcaatatcgctcgatactc

SEQ ID NO: 11088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaagtctgcggagcccggacaattgcact

SEQ ID NO: 11089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaatgaaccagcctcagctgccgatgccg

SEQ ID NO: 11090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaatgatctctggtttatgatggacaaac

SEQ ID NO: 11091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaatggtaaaaatcttaggtgtctcaaat

SEQ ID NO: 11092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaattatgagggtatataaaaaagtataa

SEQ ID NO: 11093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacagacttatacctctgtcaggggggat

SEQ ID NO: 11094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacagcctaggaagtctgaggaggtcata

SEQ ID NO: 11095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacagcgtgtcccctcaggattcaggtgc

SEQ ID NO: 11096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacatcagtgccaactgatcaattatcgg

SEQ ID NO: 11097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacatttagttctaagtagtttaaaattc

SEQ ID NO: 11098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacccggtattagtctgcatgggcgtagg

SEQ ID NO: 11099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaccctctcgaacacacatcatcgtagca

SEQ ID NO: 11100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacctagcgatccatagccggagtacgcg

SEQ ID NO: 11101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacctgatcagcaaatcgtcccccgtata

SEQ ID NO: 11102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacgggaattgactccgtcaaaacccccc

SEQ ID NO: 11103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacgtaaccggacacctcgagttactatg

SEQ ID NO: 11104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacgtccctccgttgatccaagtgctggg

SEQ ID NO: 11105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcacgtcgtgggcaatcactagcgtctcgg

SEQ ID NO: 11106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcactagatactttgatcagtacattatcg

SEQ ID NO: 11107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcactaggcgatagcccaagcggtgggaga

SEQ ID NO: 11108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcactttcgttgatatgtatgtggccgcga

SEQ ID NO: 11109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagaaatagctatctcgtcgccgtccact

SEQ ID NO: 11110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagaagatggtccgaagcttgtaagtcgt

SEQ ID NO: 11111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcagttctcgacgacttattgaccccg

SEQ ID NO: 11112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagccatcttaccgtgcacacaggaccgt

SEQ ID NO: 11113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcccaatatatgatttaagcccgcctc

SEQ ID NO: 11114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcgaaggggctggttgagatagtatat

SEQ ID NO: 11115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcgcgacccactgtagaccggcacagc

SEQ ID NO: 11116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcggctttcaatttatttaccacgatc

SEQ ID NO: 11117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcgtcgaactagtagtatcggggatgt

SEQ ID NO: 11118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcgttcctagttacaaatgcgaggtag

SEQ ID NO: 11119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagcttattcttgggttacgcaagggggc

SEQ ID NO: 11120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagctttactttaagttgggattgtttaa

SEQ ID NO: 11121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggacgccaggtacagcacgcggtctgg

SEQ ID NO: 11122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggacgggacgggaacgggtctagtctg

SEQ ID NO: 11123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggaggttttgccttagatggtacaaaa

SEQ ID NO: 11124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggattgattcgttgatcagggacccat

SEQ ID NO: 11125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggccgtttagctctacgtctctcctgt

SEQ ID NO: 11126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggcggccggttataacttgcgtgtgga

SEQ ID NO: 11127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggggtcaggacaactggtaacaggctg

SEQ ID NO: 11128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcaggtccatttcaagttcgtgggggaggc

SEQ ID NO: 11129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagtcagtggccgagccgtaagatctgtg

SEQ ID NO: 11130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagtccccccttacttagtgcgatagttg

SEQ ID NO: 11131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcagtgggagcaacttgccaaatgtgttca

SEQ ID NO: 11132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcataagtggttaggctcagatgcagttgc

SEQ ID NO: 11133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcataccatggtgcaacggttttgtcgggc

SEQ ID NO: 11134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatacgcgacgacgtagaaagtggtcgta

SEQ ID NO: 11135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatacgtatcacgcccaactgtttcatgt

SEQ ID NO: 11136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatagcatattgccttacggtgtggccga

SEQ ID NO: 11137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcataggctcgatactcgtattgattgtcg

SEQ ID NO: 11138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatattctcctccaaacggaccttaggga

SEQ ID NO: 11139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatcctagttgctatctactaccgcatcg

SEQ ID NO: 11140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatcgtgagattgttcgtttaataggagc

SEQ ID NO: 11141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcattaatgcctgcgttcacggttagctag

SEQ ID NO: 11142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcattggagacttgagcgtgttgggtctgg

SEQ ID NO: 11143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcatttattttttttcttgttcgggtgggt

SEQ ID NO: 11144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccaacttgcggaattaattatacactgct

SEQ ID NO: 11145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccaatcggaccgtgcgacgttacctcgca

SEQ ID NO: 11146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccacaactgcaggccacgatgacgtcacg

SEQ ID NO: 11147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccacatcgagaccgcgaacaaagtgttgg

SEQ ID NO: 11148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccacccgttactcgctcacgttctaaagg

SEQ ID NO: 11149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccaccctactgatgacgcggctatgcggt

SEQ ID NO: 11150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccactaagaagtttaatacggactaccgt

SEQ ID NO: 11151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccactcatatgtcgcaatcgagcgagccc

SEQ ID NO: 11152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccagatctgaagtctattcatttgcgtgt

SEQ ID NO: 11153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccagccagtgcgatcggtctctcccagtg

SEQ ID NO: 11154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccaggcctctaactaaggacgcgccggta

SEQ ID NO: 11155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccagtgggactctgcatttggaacgcttc

SEQ ID NO: 11156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccataaaacctaagcagctgtcttcactt

SEQ ID NO: 11157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccatccgcgcccacaattcggtgcttcct

SEQ ID NO: 11158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccatggaacatctagattctgccttccgg

SEQ ID NO: 11159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccaagtgatccagttggcggcgggaggg

SEQ ID NO: 11160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccacaattatgatgtgaagtattaggac

SEQ ID NO: 11161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccagcagctaacgcaaaccggggcggtc

SEQ ID NO: 11162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccagttatgtatgggggtacatgttggg

SEQ ID NO: 11163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccccgcacagcccggatctgccaggagg

SEQ ID NO: 11164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccccgttctaccggctccaggaaccgtg

SEQ ID NO: 11165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccctgtgcctctttcataggagccgcat

SEQ ID NO: 11166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgatcaaggtagatatggtaagctcgc

SEQ ID NO: 11167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgatcatttgcgtggtggaatctctag

SEQ ID NO: 11168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgcatgttatacatattttgatttaac

SEQ ID NO: 11169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccggatcggtgaaaaggtgttagtaaca

SEQ ID NO: 11170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgggaatggctatggtgttgtaaggaa

SEQ ID NO: 11171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccggtataacgcacatctgcgtcagcgg

SEQ ID NO: 11172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgtgctgactctcgtgtgctattcagc

SEQ ID NO: 11173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccgtgggtcaacagcgataggtagtatg

SEQ ID NO: 11174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccctaggaccctcgtcgcgcataccgtct

SEQ ID NO: 11175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccctccacccgacccttgattcacagacc

SEQ ID NO: 11176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccttaacaatcgccaatgatcgatcgcc

SEQ ID NO: 11177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcccttctgagaattatttgtggtgtcagt

SEQ ID NO: 11178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgaacgacagtatggaacgtgggggcac

SEQ ID NO: 11179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgactgccgtctcgtagcgcactgtctg

SEQ ID NO: 11180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgagacaccatgcccgcgcaccaagtct

SEQ ID NO: 11181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgcggaaccacactagccgtgcgctcgg

SEQ ID NO: 11182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgcttggcataatctatagctgtaatag

SEQ ID NO: 11183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccggacgcaaacccgaatgacattgcgac

SEQ ID NO: 11184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgtcagcgggtgtaagtagcgttcgctg

SEQ ID NO: 11185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgtctgttatggtgcatggtgaagggta

SEQ ID NO: 11186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgtgcaatggtgcagataagccattaga

SEQ ID NO: 11187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccgttcctaaacttttcagtactggttgt

SEQ ID NO: 11188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctaagtggcggttagatgcgggggcaaa

SEQ ID NO: 11189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctacacgccacatctcgtcagttacagt

SEQ ID NO: 11190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctcattagtacactcgactgttctccta

SEQ ID NO: 11191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctccagacgtttatcactttacaagcac

SEQ ID NO: 11192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctccatggtgaataaggacactttggcg

SEQ ID NO: 11193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctccgatgttacctactaagggtgtacg

SEQ ID NO: 11194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctctaatcgtatgcgattaacttcgaac

SEQ ID NO: 11195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctctgccaaggttattgagtgtttattt

SEQ ID NO: 11196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgccctgcattggctgggctttaaata

SEQ ID NO: 11197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgcgaagtccaacaacggtccggggtc

SEQ ID NO: 11198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgcgcgcgtggaaggaaccaccctgga

SEQ ID NO: 11199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctggttaagtgacggttctattgtgtgg

SEQ ID NO: 11200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgtcgtatacgcgcagtgattgcattt

SEQ ID NO: 11201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgtgtgaatgcactggggttccgcacg

SEQ ID NO: 11202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcctgttctctgcaagctgtacccatgcgc

SEQ ID NO: 11203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccttaccttgagtgttgttacccccgatg

SEQ ID NO: 11204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccttcgcagcattatcgagcttctgccgt

SEQ ID NO: 11205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgccttgcggtgtgagagtgtggatattttg

SEQ ID NO: 11206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaaatcattggctaggtggcatctcggt

SEQ ID NO: 11207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaacatggtccatattgaggttggcacc

SEQ ID NO: 11208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaagctcatgacgtggcgtaatggttag

SEQ ID NO: 11209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaaggtaagggacacggcggtgataggt

SEQ ID NO: 11210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaatcgttcgtacgccgtgaatgacgcg

SEQ ID NO: 11211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacaattccttaagactggcctatcctg

SEQ ID NO: 11212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacagtatcgcttggggatggcccagat

SEQ ID NO: 11213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacatttttattaggcagttctgacggg

SEQ ID NO: 11214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaccattccgtgttagcgaggtacgcgt

SEQ ID NO: 11215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacccaagggcattgatagatgtcgatt

SEQ ID NO: 11216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaccgaagtcagtatttgaggggttacc

SEQ ID NO: 11217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgaccgtccgtaccacgcatattggttgg

SEQ ID NO: 11218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacgcatgacggttcctggttgtggttg

SEQ ID NO: 11219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgacttggtgttttctatgactggctctt

SEQ ID NO: 11220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgagcagccaaggttcatgtagcgcgact

SEQ ID NO: 11221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgagggactttggggcggctattcaaacc

SEQ ID NO: 11222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatacgatcaacttcctagccattctta

SEQ ID NO: 11223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatctttgtctaagtagcagaagggatt

SEQ ID NO: 11224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatgcaattgtgggaagggaacaagttt

SEQ ID NO: 11225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatgccaccaatgatcttgcgcgcgcac

SEQ ID NO: 11226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatggacaacacgatattagctgtagag

SEQ ID NO: 11227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgatgtaacgtatggggttgttcagccat

SEQ ID NO: 11228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcaatatagcgcgatgtgaatagtctgg

SEQ ID NO: 11229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcaatccttgtatcaatttaaaactgtt

SEQ ID NO: 11230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcagcggaacgctcgggttaagtggccc

SEQ ID NO: 11231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcaggacttagcctctcgttccaatatg

SEQ ID NO: 11232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcaggtctcgtgttgcaagttgctgaac

SEQ ID NO: 11233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcataacgtccacgtagccggtttgtcg

SEQ ID NO: 11234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcattctggtcaaatttcgtacgtacga

SEQ ID NO: 11235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccagccatgtccggactgtaggtacta

SEQ ID NO: 11236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccccgttaccaaccagtgacgccccga

SEQ ID NO: 11237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcccggcagacagctaggctccgctccc

SEQ ID NO: 11238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccctacaaggtggttgaaaggcgtacc

SEQ ID NO: 11239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccgctcagtaccgttgtttgctagctg

SEQ ID NO: 11240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccggggtatctagcactgtgactcagc

SEQ ID NO: 11241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgccgtgtagggtggagcttgcacggtat

SEQ ID NO: 11242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcctacataccgctgcatcttcgcggcc

SEQ ID NO: 11243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcgaacgaagggacattgacacacgctg

SEQ ID NO: 11244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcggaggatggggttcggattaggccgc

SEQ ID NO: 11245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcgggcaccgtgttgactgagtggcacc

SEQ ID NO: 11246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcggtacaggcacgtgctagttacgcta

SEQ ID NO: 11247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcggtcgccgttagactgggaggcgtct

SEQ ID NO: 11248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcggtgcctggagctcgtggatagtccg

SEQ ID NO: 11249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgctatgcatgacaccggatccgttcaac

SEQ ID NO: 11250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgctcgctgcagcggttgaagtacatccc

SEQ ID NO: 11251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgctcgttctgtgtcagctcgggtactgg

SEQ ID NO: 11252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgctctgtctcatgacattaaggatctcg

SEQ ID NO: 11253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgctgggcgtgctcccaatcaagtgcgac

SEQ ID NO: 11254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgcttaaggggcaacccgttggctctcgc

SEQ ID NO: 11255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggaagaattctgagagctagcagtggtt

SEQ ID NO: 11256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggaatccgtcgcacaaaatgtgttatct

SEQ ID NO: 11257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggaatgctcggatgtgaaagttcgcctg

SEQ ID NO: 11258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggacaccaccagtcggacagatcgaagg

SEQ ID NO: 11259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggaccactcgggatatcgatgcatgccg

SEQ ID NO: 11260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggacggtgaatccccacggagcataaga

SEQ ID NO: 11261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggactgcagtagaacgcctacccttaac

SEQ ID NO: 11262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcaatctaaagttttctcgggaccggg

SEQ ID NO: 11263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcacgaggttcgcgctgtgcggaaata

SEQ ID NO: 11264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggccgaaagcgtgcctggtagttgcttg

SEQ ID NO: 11265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggccgtcctcgttctgctaggcttctgc

SEQ ID NO: 11266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcctttaattcggtttgtctccttcct

SEQ ID NO: 11267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcgaaggcctcagtcgggacggttgga

SEQ ID NO: 11268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcgcacgttttctggcccgcaagcttg

SEQ ID NO: 11269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcgcgtggaccaccgtagctcccctct

SEQ ID NO: 11270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcggattacacgagtgctctggttgtc

SEQ ID NO: 11271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggcgtcgatcagcgatctactccattcc

SEQ ID NO: 11272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgggcatacttggatctcgccaagtggct

SEQ ID NO: 11273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgggctgctctctaatacctgctgcggcg

SEQ ID NO: 11274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggggatagggtattttatgatcgttcgg

SEQ ID NO: 11275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggggcgaacttgattcattgcttccgag

SEQ ID NO: 11276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgggggttgcgtttgtgaggtcatcggca

SEQ ID NO: 11277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggggtcggggaggctgcgtggtctgggt

SEQ ID NO: 11278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgggttcgagtattctatctcccggccaa

SEQ ID NO: 11279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggtcgacactgactcttgcgctttcaga

SEQ ID NO: 11280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggtcgttgggcagcctgcctacactcgc

SEQ ID NO: 11281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggtctctcccttaccctaggacgcgatt

SEQ ID NO: 11282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcggtgccacggcaacactggcagcccgtc

SEQ ID NO: 11283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtacattgaatttccgtgaccaagagct

SEQ ID NO: 11284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtactgggatccgtacgtggccaatttc

SEQ ID NO: 11285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtagggagcaccgctgtacactgatgtg

SEQ ID NO: 11286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtattgttggacgttttggaaggcatcc

SEQ ID NO: 11287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtcaggcatatggcccggaattttcggt

SEQ ID NO: 11288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtcatacttattgggtcacgtctcgttg

SEQ ID NO: 11289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgaactaccacatacgttgcaccctac

SEQ ID NO: 11290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgagagccgcttcttgatgtcaccccc

SEQ ID NO: 11291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgagcaacacgttaatgcagtacgtaa

SEQ ID NO: 11292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgcaatatcggtttaaagctctagtca

SEQ ID NO: 11293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgccgtggcgtgatatgagacctaggg

SEQ ID NO: 11294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtgctgacggtgtttcccctcgactggt

SEQ ID NO: 11295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgttctgctactgactcacgcgagccggc

SEQ ID NO: 11296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgttgcgccgggttaggggacggcacatc

SEQ ID NO: 11297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcgtttagttaggataaatttgttactgtt

SEQ ID NO: 11298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctaaagaacgtaagatatggtaaatcgta

SEQ ID NO: 11299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctaagtgaataggtgggctcgtttgggta

SEQ ID NO: 11300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctacaagcgagttgaccaacaccacccat

SEQ ID NO: 11301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctacagccgcaaagcactattcttcttgg

SEQ ID NO: 11302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctaccaggcaggccgttatgatctccacg

SEQ ID NO: 11303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctacggaaatgtccgtcgtttgcgaggta

SEQ ID NO: 11304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctacgtccatcgagacacaaggcgcgcga

SEQ ID NO: 11305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctacgtctcggaagttcatcggagcgtgt

SEQ ID NO: 11306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctagctgggtagttgattcacggtacgcc

SEQ ID NO: 11307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctaggaagtcaatgttctagtttaatcgc

SEQ ID NO: 11308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctaggggtgagagtgggtgtgtggacaca

SEQ ID NO: 11309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctagggtttccagtcactcgacgaagaac

SEQ ID NO: 11310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctagttgtcgccacccgctgagttcgtcg

SEQ ID NO: 11311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctagttttaaggcgaagtacggtcggtat

SEQ ID NO: 11312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctatcaaatcgtgacgtgatcgccagtac

SEQ ID NO: 11313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctatgtgaaatttttcacataacgcggcg

SEQ ID NO: 11314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctattcgttcggacgaagcgagcaacttg

SEQ ID NO: 11315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcaacgggggacttacgtcacggtcggg

SEQ ID NO: 11316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcaacgtgggttttctactcctggtctt

SEQ ID NO: 11317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcaatccattgaaacgggcggagacaag

SEQ ID NO: 11318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcacagaaggagggcggtgtacctctgt

SEQ ID NO: 11319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcaccttgataggcaatggcgctaacgt

SEQ ID NO: 11320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcaggctaccagtaacgtattgcgcaaa

SEQ ID NO: 11321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcctcatgtgtggcttttgttgcccgtc

SEQ ID NO: 11322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcgaccggaacttgggttgtttgtcgtc

SEQ ID NO: 11323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcgagctgtcaacggggagtgttttcaa

SEQ ID NO: 11324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctcggatgatgaagtgtacatctgcacgc

SEQ ID NO: 11325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctctttacccgcagtcggttagtttcagt

SEQ ID NO: 11326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgaaggcatgagaagatcaactcctttt

SEQ ID NO: 11327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgagctgtctgagcgtatggacctggct

SEQ ID NO: 11328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcaagtgactatggtattacgcagggt

SEQ ID NO: 11329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcactcatgcgggcatcaaactgccta

SEQ ID NO: 11330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgccatatacttccccttttggttccta

SEQ ID NO: 11331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcgcggaagaatttatctgattgttgt

SEQ ID NO: 11332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcggagcaacgatcccttcgtcccttc

SEQ ID NO: 11333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcgtaggtttctgatctgcattagtct

SEQ ID NO: 11334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgctacaatccaaacgtgtcaggttgct

SEQ ID NO: 11335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgcttctgctgtgtttgctcgtcttcgg

SEQ ID NO: 11336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctggggacctacaggtgatatgcttatga

SEQ ID NO: 11337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctggtttccacggtcgtagcgttctttac

SEQ ID NO: 11338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgtatcacataacatgatatcttctact

SEQ ID NO: 11339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgtcgatgagtcacagagattttcaagg

SEQ ID NO: 11340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgttgatgtctatagcggaaccgcgggt

SEQ ID NO: 11341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctgttgcaccccacgtcaactgatacggg

SEQ ID NO: 11342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttaagacgaaaccgtgttattgcggaat

SEQ ID NO: 11343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttaggagcggttggcctccagtaagcat

SEQ ID NO: 11344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttagggcgtcatcactttgatcttgtat

SEQ ID NO: 11345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttcacacttcgatggtgtcgggtgcagc

SEQ ID NO: 11346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttccggagaccggtccctgtcgatgttt

SEQ ID NO: 11347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttctctgaccatgccacgtctcttcatg

SEQ ID NO: 11348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttctgaggcactcgtgttgaactttagg

SEQ ID NO: 11349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttgaatgacgtgcgcctgtcttgggttt

SEQ ID NO: 11350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttgacacgccatgacagctttgtgaccg

SEQ ID NO: 11351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttgcactacacggcatcaagtacacaga

SEQ ID NO: 11352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttgccgattctcttgctgcgtggtagtt

SEQ ID NO: 11353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttgtggagctaatcgtgttctgatgtgt

SEQ ID NO: 11354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctttaacactcaatgatctgatgtggtcg

SEQ ID NO: 11355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctttcctactatacctggcgctttcaggt

SEQ ID NO: 11356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctttcggacttgggtcttttcgtgtggtc

SEQ ID NO: 11357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctttctatgacaatttgacgagtcgggcc

SEQ ID NO: 11358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgctttgctggttaggcacgctattgaccga

SEQ ID NO: 11359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgcttttgcggtctacctcgtttggctactc

SEQ ID NO: 11360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaacggctaaacccgcggtttgcttctac

SEQ ID NO: 11361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaagcttttagatgcacggagtgatcgcc

SEQ ID NO: 11362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaaggaccacgggtgatattggcaggacg

SEQ ID NO: 11363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaagggagagcgggttgaagcgcccagac

SEQ ID NO: 11364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaaggtaaggaccgcgctaatacctggta

SEQ ID NO: 11365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaaggtcaacgtgttggcccatgaggcat

SEQ ID NO: 11366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaagtgcgctctcgttttcaccagtggta

SEQ ID NO: 11367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaatcaagcggtaatgccagttgcgctcc

SEQ ID NO: 11368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaatgaagtctcacgacatcaaattgacc

SEQ ID NO: 11369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaatggcgtctgacctgcttcgtaactcg

SEQ ID NO: 11370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaatgtatggctctagtttgtgcacttgc

SEQ ID NO: 11371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaattttctcgtaggccgtgcattcctgc

SEQ ID NO: 11372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacaccggctggcatcagttctcgtttgc

SEQ ID NO: 11373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacagattctgatagtggtgctactggcg

SEQ ID NO: 11374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacaggcggataccacgcttggggcggtt

SEQ ID NO: 11375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaccaatgttaataacagcagtggcgcgt

SEQ ID NO: 11376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaccattctatgtcgttacgcgtctgcgc

SEQ ID NO: 11377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacccgttggattgctgcatctgcattgc

SEQ ID NO: 11378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaccgcgatcacaaagccatcgagtcagg

SEQ ID NO: 11379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaccgggggcaatatttacgaggctatgg

SEQ ID NO: 11380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacctcgtgacgtatgatggcatcacctt

SEQ ID NO: 11381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacgaaatggtcgatctcagtggagtggc

SEQ ID NO: 11382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacgcttccgacggtacgtgtcaatatcc

SEQ ID NO: 11383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacggctcgttaggactgttctgcatggt

SEQ ID NO: 11384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacgggagcggtcttgcgaaagtaggtct

SEQ ID NO: 11385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggactatcagtgggtgaggccgggagttgt

SEQ ID NO: 11386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggacttacaggggcgcgagtggtaaagcgg

SEQ ID NO: 11387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggactttaagcgtcaatgcatctccgatat

SEQ ID NO: 11388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagagcatgtttctaagtggtcgcgcttt

SEQ ID NO: 11389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagagggttttacgggattacgatgcctg

SEQ ID NO: 11390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagatgccgaccttatagtattcttcgat

SEQ ID NO: 11391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagcgtcctttccggctccgtgtgcccta

SEQ ID NO: 11392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagctgaacaagttaacaggagtgtgttg

SEQ ID NO: 11393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaggacaggggtttctgtagtctacacca

SEQ ID NO: 11394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaggatcccgaaggcctggaggcaatcct

SEQ ID NO: 11395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaggcacttcaaaccacgttccaattctg

SEQ ID NO: 11396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagggacccctgccctccgcgttgctgca

SEQ ID NO: 11397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagggagggtttggctctataggcatgtg

SEQ ID NO: 11398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggaggtccctgactagcacttcgttcgttg

SEQ ID NO: 11399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagtaggaaacgcgctcatgtggcctggt

SEQ ID NO: 11400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagtgatctgacttgatgtacatactgac

SEQ ID NO: 11401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagtgcgtctccatccgtggactctcgtt

SEQ ID NO: 11402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggagttctctttcaggcgaaggcccaagga

SEQ ID NO: 11403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggataacgctgtccttcttgcagtgggcgc

SEQ ID NO: 11404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatattcaacaggggtgaattccttggct

SEQ ID NO: 11405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcagaagttaggattcggtggtctggg

SEQ ID NO: 11406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcagtcgtgctttggaggcgcgttttc

SEQ ID NO: 11407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcatacgacttacaccgcttcccttcg

SEQ ID NO: 11408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcatgggtcttgtcgtcctggccagat

SEQ ID NO: 11409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatccgaggctttctcttacgccacctcg

SEQ ID NO: 11410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcgccaaagaccaactcgctgtacgcg

SEQ ID NO: 11411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatcgtcttgtggccttcatcttctcgtt

SEQ ID NO: 11412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatctcccgcagtgtctggggctgtggtg

SEQ ID NO: 11413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggatgggcaaaggcggtaacgttaggtcgg

SEQ ID NO: 11414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggattccgccttttactcatctccggttat

SEQ ID NO: 11415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggattgaagttaaatgtcggcgagttaagt

SEQ ID NO: 11416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaaagtgagtcactcaggggtttgcgaa

SEQ ID NO: 11417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaagaccgtagaacttcatgtcattctc

SEQ ID NO: 11418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaatatgtgtccatatttataagtggag

SEQ ID NO: 11419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaatcaatgtctcttaagattacccatg

SEQ ID NO: 11420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaatcgaggtttagatgtgacctgctgc

SEQ ID NO: 11421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaccttaaaatcacgaacgatctgttgc

SEQ ID NO: 11422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacgcggcgcgttgtttacaaggtgctt

SEQ ID NO: 11423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacggctaccatatcccccttggacacg

SEQ ID NO: 11424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacgggagacagaatatcgaggtgcaca

SEQ ID NO: 11425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacgggcttaaatgatcctctctgggcg

SEQ ID NO: 11426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacggttgtccagctgtctgctttgact

SEQ ID NO: 11427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacttcctcccggtgccatggatggccg

SEQ ID NO: 11428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcacttcgggtggctgtgtggtctggtag

SEQ ID NO: 11429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcagcgtgttgtgcaccggttttcgcggt

SEQ ID NO: 11430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcagctatgtgcagtgcatcggacaatat

SEQ ID NO: 11431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcaggttcgtcggcacatgatccattgtg

SEQ ID NO: 11432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcatattgcgcgtacctcctctattcctc

SEQ ID NO: 11433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcatgcgtatttcgtcatatacccggaac

SEQ ID NO: 11434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcattgcttgttttatcttacccgggggc

SEQ ID NO: 11435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccaaaggcaaacaatttaccagattcac

SEQ ID NO: 11436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccacgaccaggtcactccgagggcagcg

SEQ ID NO: 11437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccacgtttgctctcctgggctggaggga

SEQ ID NO: 11438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccatgcagttatggcaaatacacgtagc

SEQ ID NO: 11439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcccataacgggattcggaattggttgag

SEQ ID NO: 11440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcccgttgatgtcggttccgccacggccc

SEQ ID NO: 11441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccctcgtcctttgccttgctctcccgca

SEQ ID NO: 11442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccctgggtcatggaaattcctacggtgt

SEQ ID NO: 11443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcccttgacactgaccttatcctaagggg

SEQ ID NO: 11444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgagattgcgacgggtagtcaagaacc

SEQ ID NO: 11445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgatgacccccaccgacggagtttggc

SEQ ID NO: 11446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgcgtttgaggtagggatagcgcttta

SEQ ID NO: 11447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgcttgagttactcttccgcagacttg

SEQ ID NO: 11448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgggtttagtcgggtcacgcttcttgg

SEQ ID NO: 11449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgtcgtccgtgggacaggggcttcgcc

SEQ ID NO: 11450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgttggatgtgtccggtcgctgcgtgg

SEQ ID NO: 11451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccgttgggtcgcagaggaaggcatttag

SEQ ID NO: 11452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcctaccgaagggaaagctcgagtcttat

SEQ ID NO: 11453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcctacgtgatagccaaggggtatgtgtt

SEQ ID NO: 11454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcctatttctatggagggcgttcgatgct

SEQ ID NO: 11455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcctggctccactggtggccgacacccgg

SEQ ID NO: 11456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggccttctacggggtggtcatacagtgtct

SEQ ID NO: 11457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgaccgtatgtcatttgctgggtacact

SEQ ID NO: 11458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgacggattagggactggatcgtgttgg

SEQ ID NO: 11459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgagcggctttctcgacgctttggcgcg

SEQ ID NO: 11460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgagcgttgaaggggataaggttggttg

SEQ ID NO: 11461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgaggtgtcttaacggatggctaccttt

SEQ ID NO: 11462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgcaccctttctccacggacgcttctcc

SEQ ID NO: 11463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgccgcgtgttgcaaagcctattgaatg

SEQ ID NO: 11464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgcggcggttgtgtcattaatttcggcg

SEQ ID NO: 11465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggactaactgttttgtgctatatcggg

SEQ ID NO: 11466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggagggttaatcttctacgtaccgcac

SEQ ID NO: 11467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggaggtttctataggcggagctatgtt

SEQ ID NO: 11468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggagtacgaaccagatttacctgaatc

SEQ ID NO: 11469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggcccgccttgagcatatcaccttaat

SEQ ID NO: 11470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggggagagtaggaagattcatactgca

SEQ ID NO: 11471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggtaagggggatagcgttccgatgagc

SEQ ID NO: 11472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggtcggtcaattttattacaggcattc

SEQ ID NO: 11473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggtgcaaagcaagggcctgactgggat

SEQ ID NO: 11474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcggttaaccatctttgaggtctagatag

SEQ ID NO: 11475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgtgcgcggtggagcgaatccgggacga

SEQ ID NO: 11476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcgtttaacgtatccgtcttgcgcactcg

SEQ ID NO: 11477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctaacgattaaggtcgacgatacgggac

SEQ ID NO: 11478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctaattgcaatgcgtgacattcccttgt

SEQ ID NO: 11479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctacgacctgctctcgattcagcacttg

SEQ ID NO: 11480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctactcacgcgcgactacttctttgccg

SEQ ID NO: 11481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctcacatagcgctgaagcctcccggctg

SEQ ID NO: 11482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctcctgtcctgtgaattgttgcatttgt

SEQ ID NO: 11483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctcgcattcgtgcaggttggtaaggaat

SEQ ID NO: 11484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctctggttcggtaacttcgctgaccgca

SEQ ID NO: 11485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctctttctggtccattcctcgggatgcg

SEQ ID NO: 11486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctgaattgtgtgctgattctcgtgggta

SEQ ID NO: 11487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctgcgtgggttttggcataaactacttg

SEQ ID NO: 11488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctgcttcatgtctggtatctttgatagg

SEQ ID NO: 11489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctgttaacttgtatgtgtctctgcgcgc

SEQ ID NO: 11490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctgtttcacccgctaaatcggcgaagtt

SEQ ID NO: 11491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcttcagttagagataatgcacgcgaata

SEQ ID NO: 11492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcttcgttcgagaaccgcgggggtgtctt

SEQ ID NO: 11493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcttcttctgttcagtcccctctctgaat

SEQ ID NO: 11494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggcttgctcgatgcgtaaccaaactcgggc

SEQ ID NO: 11495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggctttatgcacgtcactaacgactgtgca

SEQ ID NO: 11496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaaaaccacagcagttggtcatatcatc

SEQ ID NO: 11497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaaaagcgttacgagggcggctggtgac

SEQ ID NO: 11498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaaagctcacattcccacgtccactgtg

SEQ ID NO: 11499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggacaaagcaatgatctttcagcattatc

SEQ ID NO: 11500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaccagatcactaaatcttcctctcgtc

SEQ ID NO: 11501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggacgcgcccaactggtgtctcctagttc

SEQ ID NO: 11502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggactataagttaagcagtttgtgcaagt

SEQ ID NO: 11503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggagaatgtggaggcaataagtggtggct

SEQ ID NO: 11504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggagccccaaggtgaggtcaagttagtcg

SEQ ID NO: 11505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaggagccgcgcattgcctagtacgcgg

SEQ ID NO: 11506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggaggtcttggtttgcaatcataaggagg

SEQ ID NO: 11507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggatagtgttagcttttggacatttcggg

SEQ ID NO: 11508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggatcaccgttagcggagcagggtttccg

SEQ ID NO: 11509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcaataatcagggacctagggagatgat

SEQ ID NO: 11510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcaattgataaacggatggaggaaggag

SEQ ID NO: 11511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcacactaaagcgccgcgtggcttcagt

SEQ ID NO: 11512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcacactgggaggtctcgcagccattgg

SEQ ID NO: 11513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcacgggtgttatcgagcgtaaggagca

SEQ ID NO: 11514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcagttggccggcgaatacatcatcggt

SEQ ID NO: 11515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcagttttttgggtttgctcgtatggtc

SEQ ID NO: 11516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcatgcgtgtcggtattccgccgcctta

SEQ ID NO: 11517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcattgcagtcgtccactgcgtatggta

SEQ ID NO: 11518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccaccatagccggtgtacgatcggcct

SEQ ID NO: 11519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccagggctccgccgcggtttgtacttt

SEQ ID NO: 11520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccccgtacctgatcacggtatccgagg

SEQ ID NO: 11521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccgagcctggagactactgtatgcacg

SEQ ID NO: 11522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccggacaagctatcagccttgggttcg

SEQ ID NO: 11523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcctcttcagctttttagtgtgctatgt

SEQ ID NO: 11524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggccttttggaaccttaagtcagttggca

SEQ ID NO: 11525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcgagaggccaaatgcgatgtgggcaat

SEQ ID NO: 11526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcgagcaaactgacgcctgccgggaggt

SEQ ID NO: 11527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcgcacggctaatggccaaattgggccg

SEQ ID NO: 11528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcgccggcaagtattttctgagctgcga

SEQ ID NO: 11529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcgcggagtggccgcggaatcaggtggg

SEQ ID NO: 11530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggctagttggtaatggctacgagttgcgc

SEQ ID NO: 11531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggctcggaacccttgagtggtgattggtc

SEQ ID NO: 11532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggctggcgggtaataggattgcggacatt

SEQ ID NO: 11533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggctgggtcacgctcgtgccgggggcctc

SEQ ID NO: 11534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggcttcctatgctgtgagggggttcctgg

SEQ ID NO: 11535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggaacgcacggacagaatccgaggcaat

SEQ ID NO: 11536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggacatgccctttctacgtacccggaca

SEQ ID NO: 11537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggactccacggttatgccacctattcgg

SEQ ID NO: 11538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggagacggaatagggaacggacttcacg

SEQ ID NO: 11539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggattaggcggtagacaattgctggcgt

SEQ ID NO: 11540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggccaatcgggtgctactctagagcctg

SEQ ID NO: 11541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggccgtccgtgcgtcagagctgatactt

SEQ ID NO: 11542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggcctgatagtgcgagcctgagccggac

SEQ ID NO: 11543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggctaatggcgggcatatattctgttcg

SEQ ID NO: 11544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggctattgagggcctctacctacactgt

SEQ ID NO: 11545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggcttataagtttcgtgcgtagtatcgt

SEQ ID NO: 11546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggggacagatgcgttcgccacgttacctg

SEQ ID NO: 11547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggggatgttctgccggagcaaagacgtgg

SEQ ID NO: 11548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggggtaggaactcgatttcttggttgtgg

SEQ ID NO: 11549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggggtcgattttcctttcatagagcgatg

SEQ ID NO: 11550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggggtgtaagtcttgccggggattcgtag

SEQ ID NO: 11551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggtaaaataaacaacgtagatggtaccg

SEQ ID NO: 11552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggtaggccgcactatgttgattgctacg

SEQ ID NO: 11553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggtcaaactgccgtacagtgggtcaacg

SEQ ID NO: 11554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggtccatatccttgcggttcgggtgtaa

SEQ ID NO: 11555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggttcgatacaaggtgggggcagcggac

SEQ ID NO: 11556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggttcggcaacgtttgagtactcgtccc

SEQ ID NO: 11557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggggttgggcagatcctagataacagacaa

SEQ ID NO: 11558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtaccgagattctgatacttgttgcgca

SEQ ID NO: 11559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtagcggatcgcaccgttctagcggaat

SEQ ID NO: 11560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtagctaacgacgatatctttttcgggg

SEQ ID NO: 11561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtatacgaggagagcgtcgctcggggtt

SEQ ID NO: 11562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtatgggtccacagtcaattggtcgtaa

SEQ ID NO: 11563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtcagtcagtgcggtaaaccgtcacagc

SEQ ID NO: 11564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtccctgtgcatgccactgctattgcct

SEQ ID NO: 11565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtctgttgtcccggcaactatttgaacc

SEQ ID NO: 11566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtcttacctgttaagttctgctttggat

SEQ ID NO: 11567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgcagctcctgccggactttgcatccg

SEQ ID NO: 11568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgcgatcctagtcaaaacgctgcggtg

SEQ ID NO: 11569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgcgcattgatgcatgtctaggcgctg

SEQ ID NO: 11570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgtctccactgtccatttgaaagtgct

SEQ ID NO: 11571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgtgtgggagcggacgcagacgggggc

SEQ ID NO: 11572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtgttgacattttttagtagaacttgtg

SEQ ID NO: 11573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggttactttggcttccacgtcattcggac

SEQ ID NO: 11574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggttatgcaatacggggtgtacttcccgt

SEQ ID NO: 11575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggttggaaccgcaaagttgtacctttttt

SEQ ID NO: 11576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtttagcagaatgcacgtatggccctat

SEQ ID NO: 11577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtttatttccactgcatcattttcttta

SEQ ID NO: 11578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgggtttcaagaggttactcactgataacga

SEQ ID NO: 11579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaaaatctctgccgttggggatcatcac

SEQ ID NO: 11580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaaagaaggagggtcggctgcaggattt

SEQ ID NO: 11581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaaaggcgaatggtcagatccttggact

SEQ ID NO: 11582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaaccgctattacggcagagaccgcccg

SEQ ID NO: 11583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaacctctactcccaggtctgtggtaaa

SEQ ID NO: 11584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaacggtatgcgacgtaacgcttagtcg

SEQ ID NO: 11585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtaatgactacattgtacaccgatccaca

SEQ ID NO: 11586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtacgagatcgacctgttatcggatcgtg

SEQ ID NO: 11587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtacgatgctggacgaggtgaatgttgtt

SEQ ID NO: 11588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtacgtggagaaggagcggggtgggagct

SEQ ID NO: 11589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtagccttaatctttctttaaacctggct

SEQ ID NO: 11590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtagcggctacctctttaaggtgggatag

SEQ ID NO: 11591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtagtggtaattgcatacgagcaattgcg

SEQ ID NO: 11592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtataaataccggtagatcaatgtaccct

SEQ ID NO: 11593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtataatcgacggaactggttcttaactg

SEQ ID NO: 11594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtatcccccggcctatgcatagaggaaga

SEQ ID NO: 11595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtatcgctcatagcgagagtgtcttggcg

SEQ ID NO: 11596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtatgtgtattcctggtttatgtttgctc

SEQ ID NO: 11597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtatttcggaactgttttcgtggctaact

SEQ ID NO: 11598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcaatcgcgcgtgctgcattcctacccc

SEQ ID NO: 11599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcacactacctcagtatatcccgtgttc

SEQ ID NO: 11600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcacgcacaattagccgtttcaggtctc

SEQ ID NO: 11601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcagtacatggtagaatggggaaactgt

SEQ ID NO: 11602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtccattattcggtagcccggaacagtac

SEQ ID NO: 11603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtccattttcagcgactcctcaaaggtgc

SEQ ID NO: 11604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcctcgtggatgggccggcgtggtactc

SEQ ID NO: 11605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcctggctatttgtatcaccctctctga

SEQ ID NO: 11606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcgaatggtagataggggtcgatacacg

SEQ ID NO: 11607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcgcatccatagcacgtcatatcgttcc

SEQ ID NO: 11608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcgctggtctcggcgtttgatacatgct

SEQ ID NO: 11609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcgtggtggggtagtatcttgggctttc

SEQ ID NO: 11610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtcttacgttccgcagctatggctcctta

SEQ ID NO: 11611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtctttgttttcgattgggcgagcagcgt

SEQ ID NO: 11612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgaatggtggggtatcgatgtccctagg

SEQ ID NO: 11613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgactggggaatcgcactcaaccactac

SEQ ID NO: 11614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgcaacctcaaagggtaagccggatttc

SEQ ID NO: 11615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgcatagctgcctttctttttggcccat

SEQ ID NO: 11616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgcgcaccacatataatgggtttacttt

SEQ ID NO: 11617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgggaatctgggcattaaatcgttcttg

SEQ ID NO: 11618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtggggccggataacgatttctgtaccgc

SEQ ID NO: 11619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtggtcacgggagaattgtcgagagggcc

SEQ ID NO: 11620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtggtggctcacatcataactgatgcgtg

SEQ ID NO: 11621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgtatcgatatcctggcatttttggctt

SEQ ID NO: 11622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgtatcttgaacacttagctgtgtctgc

SEQ ID NO: 11623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgtgggtggtttctcatttatgaccttg

SEQ ID NO: 11624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgttacaccagttcgtgcgagcttagcc

SEQ ID NO: 11625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtgttcttttacgacggacatatgccgtg

SEQ ID NO: 11626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttaatatgcgcaagtcagtagacattcg

SEQ ID NO: 11627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttaatcctagttctggcccgcaggttac

SEQ ID NO: 11628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttacgggtaaggcaggtgcggagattcg

SEQ ID NO: 11629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttagggtcgatttaggccgggtcgcagt

SEQ ID NO: 11630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttaggtttttgtgatcacgtcgatggtt

SEQ ID NO: 11631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttagtctatattctatacttttttgtac

SEQ ID NO: 11632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttattactttttggggtcctggtatggc

SEQ ID NO: 11633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttcagttgtgggccccacgccgtcgagg

SEQ ID NO: 11634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttcttggattacgggctcccaactacta

SEQ ID NO: 11635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgaatgtgtttgcgccgtgtatgctgg

SEQ ID NO: 11636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgacagggcgaacgagtgtattttctg

SEQ ID NO: 11637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgacatatagcattcaagctttattgt

SEQ ID NO: 11638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgcggagcccgcgagttgtgggtttgg

SEQ ID NO: 11639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgcgtaaatcggattgttatgatactt

SEQ ID NO: 11640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttggtgggatacatagcgatttctgcgc

SEQ ID NO: 11641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttgttggtacccggtttttaggcctatc

SEQ ID NO: 11642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtttcgtgcagttatggcctgcctgctta

SEQ ID NO: 11643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggtttgcgaacacgccttgtagctttgaca

SEQ ID NO: 11644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atggttttgttaccataggcctaggatgggtt

SEQ ID NO: 11645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaaaggccatgatagccctgttcacggat

SEQ ID NO: 11646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaaatatcctgtctcattcccgcacgctt

SEQ ID NO: 11647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaaatctggcctaggtgctccagccgacg

SEQ ID NO: 11648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaaatgagtgacacgtgtgggcccggtaa

SEQ ID NO: 11649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaacaatatacggtttgtcgactattact

SEQ ID NO: 11650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaaccagtcctgtgtttgcggtgaacggg

SEQ ID NO: 11651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaagggtcgactgtcagagtgtctccatg

SEQ ID NO: 11652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaatgtcaggcagtcggtaaattgattcg

SEQ ID NO: 11653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacaattagcatatgttgggataacaaag

SEQ ID NO: 11654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacagtagacgtttgcagctgtaattttc

SEQ ID NO: 11655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacatgtgcctggctggaatctgtccggg

SEQ ID NO: 11656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaccactggtaccctcggccgttgcgcgt

SEQ ID NO: 11657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacgatggttgatcttcgttcctgacctt

SEQ ID NO: 11658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacgctctctggatatgccagcagccggc

SEQ ID NO: 11659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacgtagaggaacatccaaggagcgctgc

SEQ ID NO: 11660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacgtcgcggtgaggtccgattcgtgatc

SEQ ID NO: 11661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtactgcattgccatatttttcacatcgtg

SEQ ID NO: 11662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtacttgtgcttttaggcgagtagttaggt

SEQ ID NO: 11663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagagcgggagatgttccatgatattgat

SEQ ID NO: 11664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagagtgtccgaggctggttaatgttggc

SEQ ID NO: 11665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagcattgccaatgcaccggcgcgtttcg

SEQ ID NO: 11666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagcctgtggcaccgcaatgtgggacgtt

SEQ ID NO: 11667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagcgataacgctgaaacgcaattcggca

SEQ ID NO: 11668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagcgcacgccatccagtaccacttaccc

SEQ ID NO: 11669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaggacgcttctacaaatgtgtgtccatg

SEQ ID NO: 11670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaggagtacaacgtgcctgctcgggcgct

SEQ ID NO: 11671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaggcacgcagactattatctggtccttc

SEQ ID NO: 11672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaggcgcaccgtcttctacgccttagact

SEQ ID NO: 11673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtaggtctgatgagtcattttgctcaacac

SEQ ID NO: 11674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagtagcaacaaagaggtgttcgttgatt

SEQ ID NO: 11675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagttccgagtagatgcattttttgtagc

SEQ ID NO: 11676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagttccgatgccctcggtcctcatggca

SEQ ID NO: 11677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtagtttgggttcactaacaggccggtcat

SEQ ID NO: 11678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtataaggttgatacttcagcgtttgtacc

SEQ ID NO: 11679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatacctcgatgttaggctggcggggtgc

SEQ ID NO: 11680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatacgggactcgctcactgccacctgtc

SEQ ID NO: 11681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatagatgcagatcgtaattgcgttgcgc

SEQ ID NO: 11682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatatatgctagttttcttgagggtctgg

SEQ ID NO: 11683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatatgtggtgaatcgccgtaacaagtaa

SEQ ID NO: 11684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatcaagatcgaaatctagcgggtacgag

SEQ ID NO: 11685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtatgatttcttatccctgagccttttatt

SEQ ID NO: 11686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtattctcctaaccagtatgcaattcgtac

SEQ ID NO: 11687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcaacaaggccagcacatccagagcagcg

SEQ ID NO: 11688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcaacaagtttgggagcctgctctccgcg

SEQ ID NO: 11689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcaacgtgcgaatttttgtacatcgcgcc

SEQ ID NO: 11690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcaccattccaacggggcttagtatcccg

SEQ ID NO: 11691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcacttccacatcccggaataaaagtctc

SEQ ID NO: 11692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcactttctactgaagcgattgttaaacc

SEQ ID NO: 11693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcagagcagttgcgtagccggtaggtggt

SEQ ID NO: 11694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcagcgctatacgtgcaatatgggagttt

SEQ ID NO: 11695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcagcgtctagtcctgatgatgctcagtt

SEQ ID NO: 11696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcagtgatatgaattgggggggttgataa

SEQ ID NO: 11697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcagtggcggatgttatcgctggattgtg

SEQ ID NO: 11698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcatcggggccatgttgagttcccttcac

SEQ ID NO: 11699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcatcgtgattggagcctctgggtatccg

SEQ ID NO: 11700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcatcttattttggcgttattctagtatc

SEQ ID NO: 11701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcatgttcattgcatgcgtctacaatcga

SEQ ID NO: 11702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcattagatggtgaaccgaccggcgttgg

SEQ ID NO: 11703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccaacattgtggtctcacctctcgtttt

SEQ ID NO: 11704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccaccagttctgtccaaggtgtggcgct

SEQ ID NO: 11705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccagggcgggatcgtctgctgcgggtgc

SEQ ID NO: 11706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccatgtgaaggtatagctgcaatgggcg

SEQ ID NO: 11707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccccacggtgatctggcggcaggggttg

SEQ ID NO: 11708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccccagtcaactcttacatccagggtcg

SEQ ID NO: 11709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcccgcgatatcatagtagtccccctggg

SEQ ID NO: 11710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccctgacgatactaatatcgtctggagt

SEQ ID NO: 11711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccgcgcagctactccccgggtgggttgc

SEQ ID NO: 11712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtccggtcacatatcccttcatcggtgcca

SEQ ID NO: 11713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcctaccggaagggcgcgttattatccgc

SEQ ID NO: 11714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcctgtcttatccccatgacaggagtttg

SEQ ID NO: 11715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcctttatggtggaggtaggctgatgtgg

SEQ ID NO: 11716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgagagggccaccacgcaacgtgccagg

SEQ ID NO: 11717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgatctctggcccgtgtgcgttttggtt

SEQ ID NO: 11718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgccgttcagatatgggcggcggccgtt

SEQ ID NO: 11719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgctatacgacatggcatattcacgcgt

SEQ ID NO: 11720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgctcgggaatgaggggcggcgattggt

SEQ ID NO: 11721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcggagaagcacacaacggtgccagcggg

SEQ ID NO: 11722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgtgcggatcgcttgaggggggtgaact

SEQ ID NO: 11723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgtgggccacgcggggttccccggtagc

SEQ ID NO: 11724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgtttgcgtgtttaatcggctgatccgt

SEQ ID NO: 11725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcgttttaaccgtctcctacactagtggg

SEQ ID NO: 11726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctaatgcttccatttctgggtttgggga

SEQ ID NO: 11727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctaggtgctacgaaatgcgaggtgcctt

SEQ ID NO: 11728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctccttgcacggaatggtccttggcctc

SEQ ID NO: 11729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctcgcggttaagtatccggcagtccttt

SEQ ID NO: 11730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctctgtctggtagacaggctaaccaggc

SEQ ID NO: 11731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctctgttgcttggctacgtgtttgcgct

SEQ ID NO: 11732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctgccccgcaatctcggtcaactaccct

SEQ ID NO: 11733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctgcgcggcgatcaggtttctgggtgaa

SEQ ID NO: 11734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctgtgtacggtgcgatctttgtggaagc

SEQ ID NO: 11735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctgtgtcgacgtgtccctcgaggtgttg

SEQ ID NO: 11736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcttgcatgattctggtgcgtgattcttt

SEQ ID NO: 11737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcttggcccaccggttcaatagcatcggt

SEQ ID NO: 11738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtcttgttagtggcacatgtgagagttagc

SEQ ID NO: 11739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctttggtgttcggggatcatttcgcgcg

SEQ ID NO: 11740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtctttgttaggcctcttcaggcactaccg

SEQ ID NO: 11741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgaagtaggatcccatactttggcggtcg

SEQ ID NO: 11742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgaatgtgagccagtgagaaggttagacg

SEQ ID NO: 11743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgagagtaacgtcaaatcgccgtgcagta

SEQ ID NO: 11744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgatcaacgcctgcatacaccgggtggtg

SEQ ID NO: 11745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgatctaatatgtgcgttcccaccttgat

SEQ ID NO: 11746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgatctttcctatgctacgttgcggtatt

SEQ ID NO: 11747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgatgatcctacgtcgcgaccagatgccg

SEQ ID NO: 11748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgatgcagctggcatcgggtggatgtcat

SEQ ID NO: 11749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgattcatattgacaaactatatagtcgc

SEQ ID NO: 11750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgattggggtttagggtgttgcacgttcg

SEQ ID NO: 11751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcaagtctctgctcgttacactaataat

SEQ ID NO: 11752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcactgagtggcgccatttaactccaaa

SEQ ID NO: 11753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcactttagtttctcgtacctttattcg

SEQ ID NO: 11754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcaggatggacgcgtgtactgtgtggtg

SEQ ID NO: 11755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcagggttcttgcaggggatcgcgcctc

SEQ ID NO: 11756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgccaattaagtagtctcggtgcgttttg

SEQ ID NO: 11757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgccctaggggacctccccagtttaggcc

SEQ ID NO: 11758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgccgattcgatcgtagtcggattgtatg

SEQ ID NO: 11759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgccgtaaatcgccaagacggtcctcgcg

SEQ ID NO: 11760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcgaaggtaaaagcggcagttggtcatg

SEQ ID NO: 11761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgctagagcaaatgtgatacggagggggc

SEQ ID NO: 11762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgctatccccccacgtctgcatgatgtta

SEQ ID NO: 11763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgctcggtcggtcatgataattaatttga

SEQ ID NO: 11764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgctgcaatagtcatatagaatgcagttt

SEQ ID NO: 11765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgcttacggccctaaggttcgtacttaat

SEQ ID NO: 11766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgctttatagcatgtttaaccgatctggt

SEQ ID NO: 11767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggaacgtgggggtctcactcgtataaat

SEQ ID NO: 11768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggagttgcgcagccggtcaggcacggta

SEQ ID NO: 11769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggatgagcatcacggatgtcaatttaga

SEQ ID NO: 11770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggcaggcgctatagacaaacataccttg

SEQ ID NO: 11771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggcgcagttattgcatgggatgtgattt

SEQ ID NO: 11772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggcggtttccaggaatcgtactttcacg

SEQ ID NO: 11773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggagatttccattaacgagcgactctg

SEQ ID NO: 11774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggcccttcgggtgactgttaattgtat

SEQ ID NO: 11775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggccgtggacatcgaatgacgaggatc

SEQ ID NO: 11776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggcgcctgcaattcctggcatcgacgg

SEQ ID NO: 11777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggcggttctccttaactaaatcgtgtt

SEQ ID NO: 11778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggggactggtacgtaatgctgcgagggg

SEQ ID NO: 11779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgggggcggccggatatgtaggctggtcg

SEQ ID NO: 11780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggtaaaatacacgatccgaaggttcgcg

SEQ ID NO: 11781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggtacatatggggatactctttagtccg

SEQ ID NO: 11782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtggtggatcgctttttcgggtcggatgga

SEQ ID NO: 11783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtacccatctagaaatggcataatcgag

SEQ ID NO: 11784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtatctgcaaacggcatgtcgcgcaatg

SEQ ID NO: 11785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtccgggaccgcgcaccccttgtatcta

SEQ ID NO: 11786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtgacggaattctcaggctttagtttgt

SEQ ID NO: 11787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtgagaaacgatccgtattccccaatga

SEQ ID NO: 11788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtgcggtacaatttcctagggttctgaa

SEQ ID NO: 11789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtgcttttagtaaaccttaccttttggc

SEQ ID NO: 11790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggaatgggaacgagctttcgttcgca

SEQ ID NO: 11791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggaggtgagctcgcaccagtacgcct

SEQ ID NO: 11792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggataacactcatggagtgcccctga

SEQ ID NO: 11793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggatgggcgattgtttcacagtactt

SEQ ID NO: 11794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggggagcttgcttcctagggtttcca

SEQ ID NO: 11795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggggtaatatccctggttcatcggga

SEQ ID NO: 11796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggggtgatcgaacttcgtccatgctc

SEQ ID NO: 11797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggtcatcattgcagttatctcggcgg

SEQ ID NO: 11798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtggtgcattccacattgtgattggtac

SEQ ID NO: 11799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtgttttgtggcttaacaaggcttgttg

SEQ ID NO: 11800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgttaaaacgccgatgattggtccctgca

SEQ ID NO: 11801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgttagctggtctgatcccggcccagagt

SEQ ID NO: 11802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgttggattaaatgatcataaggcggtca

SEQ ID NO: 11803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtgtttagtgtccgagactcacatgagacg

SEQ ID NO: 11804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttaagatagtcgaatgtctgtttcattgc

SEQ ID NO: 11805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttaagtggatgggacactgcatggtcccg

SEQ ID NO: 11806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttacacccattccgcgcaataatgcctct

SEQ ID NO: 11807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttactggagcctcttcaagattcgcggta

SEQ ID NO: 11808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttagggcggtacaattgcgggcgacatcc

SEQ ID NO: 11809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttagttgatctaacgtcgttcttaggagg

SEQ ID NO: 11810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttatcatgcgcccaatcgttattgtggcg

SEQ ID NO: 11811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttatctggtaatggcgtgatcattctgtg

SEQ ID NO: 11812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttatgcagtccgacctgcgtggaggccga

SEQ ID NO: 11813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttattattgaatccttgaatcttcttaga

SEQ ID NO: 11814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcaaggatgcagtccgctttaaactcgt

SEQ ID NO: 11815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcaagttacataagttgcggactactct

SEQ ID NO: 11816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcaccttcgctcatattcccgacaccgg

SEQ ID NO: 11817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcacgggcagtccaaggtcgtttacggg

SEQ ID NO: 11818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcagagtagttaatccgaggcagctcct

SEQ ID NO: 11819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcagttgctgattgtaacgggccctcat

SEQ ID NO: 11820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcatggggatcaggagttcgttcgtgcg

SEQ ID NO: 11821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttccaggcggacttgaggctcaggtttat

SEQ ID NO: 11822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcccgtagcccttcccatcaccaaacta

SEQ ID NO: 11823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttccgccagaaaacgctgttcgtcagtcc

SEQ ID NO: 11824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttccgtggactagggttcgggcatgcgat

SEQ ID NO: 11825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttccttgttcggggcagggctattatgta

SEQ ID NO: 11826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcggggtgggcgtgagaccggtgagagc

SEQ ID NO: 11827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcgttctcttagggaggtccgtggcgat

SEQ ID NO: 11828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttctaagaatccgtttttaaggggtgccc

SEQ ID NO: 11829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttctacgcctaaattcaatgcggggtctt

SEQ ID NO: 11830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttctgagcactctagcttagcccccttga

SEQ ID NO: 11831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttctgttccgccaattctcgtgcttttga

SEQ ID NO: 11832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcttcgggctttgacctgcaatagcgcg

SEQ ID NO: 11833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttcttgagtacatgatctcgtgtattctc

SEQ ID NO: 11834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgagctataaccacgtagctatagtttt

SEQ ID NO: 11835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgcgcaatatcgcaggccgacaccgcct

SEQ ID NO: 11836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgcggcagttaagggtgacaggcccggc

SEQ ID NO: 11837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgctctaatctagtcgtagtcctttgtt

SEQ ID NO: 11838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttggctaatgaaggcctcaaacggcaggt

SEQ ID NO: 11839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgggaacataccttgtttgacttggcat

SEQ ID NO: 11840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgtcctacgaggtacacccgttcgtttg

SEQ ID NO: 11841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgtcgccgagtcaaaggttgccgcctgg

SEQ ID NO: 11842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgttatgcgtttgactaccggctccccc

SEQ ID NO: 11843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgttccctgctatgtaccggtttataag

SEQ ID NO: 11844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgttgttggttataacatagtagtgacattc

SEQ ID NO: 11845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttaaagtgttctttatcgatccgttggc

SEQ ID NO: 11846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttagaaggccgttatgtttgtcaggtta

SEQ ID NO: 11847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttatgtgttaaatatgaccctatagagc

SEQ ID NO: 11848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttcaagtgtttattcgtaggtctaggtc

SEQ ID NO: 11849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttcgtatttacaagggggcgcgttcggc

SEQ ID NO: 11850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttcgtcattcgcgtacctgcttttccgg

SEQ ID NO: 11851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttctatagtcttaattactgtttgggtt

SEQ ID NO: 11852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttgacggcatgtccttttcgtcgccggt

SEQ ID NO: 11853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttgcgtattggcgttttattggcggtct

SEQ ID NO: 11854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttggcaggttcatacagctactttgccc

SEQ ID NO: 11855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttggtagactccggagttcattggagga

SEQ ID NO: 11856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttgttgtgtgtagtcagataagaaccaa

SEQ ID NO: 11857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttttagatgcgaccatgatcgtggtaca

SEQ ID NO: 11858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttttgcggtgaatcgtttccgcgttctt

SEQ ID NO: 11859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttttgtaagacgctatttcaagctaaca

SEQ ID NO: 11860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atgtttttttttgcccagtaataccgctatat

SEQ ID NO: 11861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaaaaacatacgcggcatgtagggatgatc

SEQ ID NO: 11862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaaagtagtggatagctagtgaccagcgcg

SEQ ID NO: 11863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacaaccagattgatgatacgtgtatttt

SEQ ID NO: 11864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacaacttcggggatgtttccacctgcgt

SEQ ID NO: 11865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacaaggatacgggggcgctcgagctgtc

SEQ ID NO: 11866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacaatgttaattgatgaacttggccatt

SEQ ID NO: 11867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacacgaccatggccattccttgtcttag

SEQ ID NO: 11868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacagcccactttctgcttagattcaacg

SEQ ID NO: 11869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaaccaaacccgtgccctagcttttcccgt

SEQ ID NO: 11870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacccctcctgctatgcgccgacgtaagg

SEQ ID NO: 11871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacggatggcattatccattctggtagat

SEQ ID NO: 11872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacggcaggaatgactcgttgcggtgggg

SEQ ID NO: 11873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaacgtctgttgatagacactcttcattcc

SEQ ID NO: 11874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaactgcctttctttcactcattacggtag

SEQ ID NO: 11875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaactgtaacagagccatatactttgacct

SEQ ID NO: 11876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaactgtgtagcaaaatcgtcttttggtct

SEQ ID NO: 11877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaagcaagttcacagctcccagcgttgccg

SEQ ID NO: 11878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaagcgtgttagatcgatgtggcgggattg

SEQ ID NO: 11879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaaggcaagaacattatggccctattcatt

SEQ ID NO: 11880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaagggaagcagtaatctgatactttttta

SEQ ID NO: 11881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaagtcgttgtcttacatagtcttggcttc

SEQ ID NO: 11882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatcacgaagagagcatcttagggtccgt

SEQ ID NO: 11883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatgctaagatatgcgcatgcttacacct

SEQ ID NO: 11884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatggattccaaacacgcatccggcctat

SEQ ID NO: 11885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatgggattgcgtgcatatcacatgatag

SEQ ID NO: 11886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatgtcgtcccattgagcgtgggtggtaa

SEQ ID NO: 11887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaattgctcaccgcagccggcaacgtgtag

SEQ ID NO: 11888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaatttattaagttagaaccttttcataaa

SEQ ID NO: 11889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacaaactggctgggcggggagtggtagtg

SEQ ID NO: 11890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacaacgacccaactccgtacctagttgcc

SEQ ID NO: 11891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacacagctcattatggagtccgctctcct

SEQ ID NO: 11892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacacgactttcatgtctttgtaatagtgt

SEQ ID NO: 11893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacacttccagtcttggagtcgccgggagc

SEQ ID NO: 11894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacagaatagaaccgcgtgtgtccaatacg

SEQ ID NO: 11895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacatatgacggtatcgagtgaagtaattc

SEQ ID NO: 11896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacatattgtggggttgtgtcatggctatt

SEQ ID NO: 11897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacatctatgccgggagggttttcacgaga

SEQ ID NO: 11898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacattcggtttaggtggaactacgggggc

SEQ ID NO: 11899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccaacgtgtcgtatgaaatagtgggctt

SEQ ID NO: 11900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccactgatttgcgcggcttgacatggcg

SEQ ID NO: 11901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccccgggatactgccaattcataggcgg

SEQ ID NO: 11902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccctttacagtcaagagacgtgtgaaac

SEQ ID NO: 11903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccgacatcggcttggcgtacctccccgt

SEQ ID NO: 11904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccgactcttgccagacaggtttagtaga

SEQ ID NO: 11905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccggacatttaggttagcgcttacgact

SEQ ID NO: 11906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccggattcctttgatttatgggcgtaat

SEQ ID NO: 11907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaccgtcagaactacgcccatcacgaggtc

SEQ ID NO: 11908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgaagcgtttgcctggtatggcaatgtc

SEQ ID NO: 11909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgaccttatctgtatttgcattattcaa

SEQ ID NO: 11910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgagaacgaacactagttgggttaagcc

SEQ ID NO: 11911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgaggtccaacacctaaagttcagtgca

SEQ ID NO: 11912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgaggtggtttccggaatagatcgcggt

SEQ ID NO: 11913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgatcgtgttgctaacatctcaccttac

SEQ ID NO: 11914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgcgtacgctctttcatttctagaaggt

SEQ ID NO: 11915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgcgtctatcgctcttatcgctatagag

SEQ ID NO: 11916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgctgctattcccgaggccccccggctg

SEQ ID NO: 11917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacggggtctcgcttcggatcatcaggggt

SEQ ID NO: 11918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacggtcatatcctatttgatcgacgggcc

SEQ ID NO: 11919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacggtttagccggaaaacgctccgtatga

SEQ ID NO: 11920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacgtcacctgtagtttcttgtgcaaacct

SEQ ID NO: 11921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactatgcttgttcgtgtagtgtgtgcccc

SEQ ID NO: 11922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactcgcgcgttcaggcactcctcacgtcg

SEQ ID NO: 11923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactctaccacgaatccgggtcgagggaga

SEQ ID NO: 11924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactggatcacgcgctcttccagatggtat

SEQ ID NO: 11925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactgggatcgaggcaacagagtcgctccg

SEQ ID NO: 11926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactgggccgtctagaagaaatcggctaca

SEQ ID NO: 11927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactgtcaactcccgggtgcgaggtatatc

SEQ ID NO: 11928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacttcgctggtaatagtaagttcaccaca

SEQ ID NO: 11929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attacttcgggctcaacgatatgcccatacct

SEQ ID NO: 11930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attactttgatagtccttcgtttggaaccctg

SEQ ID NO: 11931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagacactcgcaaccccgcgtagttctatc

SEQ ID NO: 11932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagaccgcacgctgcttgccgggcttgagc

SEQ ID NO: 11933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagacgcctcccttgctactagattcactt

SEQ ID NO: 11934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagacgcgtggtgtatttgggcttgataac

SEQ ID NO: 11935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagacggtgatctggtgcttcacgtgcgcg

SEQ ID NO: 11936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagagaccacgtgagggggggcttataccg

SEQ ID NO: 11937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagaggcgtgctaatgttggactggctcgc

SEQ ID NO: 11938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagatagttctatcgcgacacgataattac

SEQ ID NO: 11939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagatccggtattgaaacggtattgaccct

SEQ ID NO: 11940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagatgtcgttatgtgtgcagaaaatggtg

SEQ ID NO: 11941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagcacgattgaactgatgggactttaccc

SEQ ID NO: 11942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagcataacgctgagtctgaataccccagg

SEQ ID NO: 11943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagcatgcgtcacggtttcattcattgttt

SEQ ID NO: 11944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagcattgagtgtgtacgttttcccgccgc

SEQ ID NO: 11945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagcgtgcaatgtttgcggccatgtccggc

SEQ ID NO: 11946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggaaccgtggcgtacaactagtcgtccc

SEQ ID NO: 11947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggaacgctcaagtccctttgacggtcgg

SEQ ID NO: 11948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggatgaacttgtgatcatgccgatcatg

SEQ ID NO: 11949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggcagtaaagctgatgccccattgcgtt

SEQ ID NO: 11950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggcatgtgccttgcgtagtgtcgcatgt

SEQ ID NO: 11951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggcggtgtccactcgctctgagcccttc

SEQ ID NO: 11952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagggcatttggggtgggaatacggggccg

SEQ ID NO: 11953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagggctacgtctctaagttggtttgttgc

SEQ ID NO: 11954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagggggcgcagtttttgaccgtctgtttt

SEQ ID NO: 11955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagggtgtaggtgcaattagatcggcagat

SEQ ID NO: 11956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggtagccacggatggtgctgtgatgaga

SEQ ID NO: 11957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggtagcgatctcaaaccagtgtcgggtt

SEQ ID NO: 11958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attaggttattgttctcgacacacaagcccga

SEQ ID NO: 11959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagtactctagcgcaaaatccactgttcga

SEQ ID NO: 11960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagtctctttgatttaggattagtacgtac

SEQ ID NO: 11961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagtgcgggccgtcagttgccaggagggct

SEQ ID NO: 11962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagttcatatgtgcggtaactcgttacgca

SEQ ID NO: 11963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagttgttctattccggtgggtgctgtggg

SEQ ID NO: 11964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attagtttggaatatgctggtatctgattgtt

SEQ ID NO: 11965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attataagcgcggcttataaggctggttctgt

SEQ ID NO: 11966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcactcggcaagcgccatccggttgttt

SEQ ID NO: 11967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcagaaggtcagccgaggaacgagtatc

SEQ ID NO: 11968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcaggtctcgaccgcgatcctcactagg

SEQ ID NO: 11969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcataggccgctccaactgtctcacatc

SEQ ID NO: 11970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatccgataggttgaacatcctgtcttgcc

SEQ ID NO: 11971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatccttcgcttgcatcaacgccatccgtt

SEQ ID NO: 11972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcgcgtttaacactttgctccgctcgcc

SEQ ID NO: 11973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcggagcgctgacgggtactggggatct

SEQ ID NO: 11974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatcgttgatgtctcctttgtactcaagtg

SEQ ID NO: 11975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatctcgtatattcacttactggacgttct

SEQ ID NO: 11976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatgcacatcgtaagacgggcaactatcaa

SEQ ID NO: 11977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatgctgaaagggttaaggcgggttataag

SEQ ID NO: 11978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatggcgctctttagagttatgctacacgg

SEQ ID NO: 11979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatggtcaagactagcaatcaaattgataa

SEQ ID NO: 11980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatgtcaggcccgtggggaaaacagtcacc

SEQ ID NO: 11981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatgttcgggaaggggcaaacaagggaccg

SEQ ID NO: 11982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attatgttctgcccggaatccctctgttgcgg

SEQ ID NO: 11983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattatacgtcgtaagcgcgctgatgattt

SEQ ID NO: 11984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattcaacgcagactgtacgaccacagacg

SEQ ID NO: 11985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattcaagccgaggagcaacagccggccgt

SEQ ID NO: 11986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattcctagcgttgaagcatgtttttatat

SEQ ID NO: 11987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattctaggtccatatttattctcaagtca

SEQ ID NO: 11988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattgcccttactgagcgccagttctccgt

SEQ ID NO: 11989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattgtcacacagtctactcccttctttca

SEQ ID NO: 11990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attattgtgcccgtcaccgaagttcgaacact

SEQ ID NO: 11991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaaaattgcatcccggcacgttcccctgc

SEQ ID NO: 11992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaacgatgatcacgaagtttcctccggtt

SEQ ID NO: 11993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaactacctacaaagtgagatgccgcttt

SEQ ID NO: 11994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaagagcttggcattaagatgcgccttgt

SEQ ID NO: 11995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaaggtttgtatggatcctagctatagcg

SEQ ID NO: 11996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaagttcgtcatatcttagcttcgacggt

SEQ ID NO: 11997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaattttccacccttcctaaactcatatt

SEQ ID NO: 11998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacagcttaggaatcggcggaacctgtca

SEQ ID NO: 11999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacatcgttagtacaggcagagctactcc

SEQ ID NO: 12000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacatgacctgtggttacttacgagtttg

SEQ ID NO: 12001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaccccacggccacatagtataccacgta

SEQ ID NO: 12002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaccgatggcgccggcttagtttacggcg

SEQ ID NO: 12003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacctccatctctgttttgcagtgagata

SEQ ID NO: 12004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacggcactggccgtagacgtgcaggtcg

SEQ ID NO: 12005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacgtcattattgtcgaagccgggacacg

SEQ ID NO: 12006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcactacgccggttgctagacttttgtggg

SEQ ID NO: 12007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacttcccgcttcacgctagatgtttgtt

SEQ ID NO: 12008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcacttgtagctacgatccccgttcactgc

SEQ ID NO: 12009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagatacacgcctagggaatgagactagt

SEQ ID NO: 12010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagatgatactgtagaccgttattggagc

SEQ ID NO: 12011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagcatgcttctccctagttgccaagtcg

SEQ ID NO: 12012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagcctgtaaggacgggggctctctgcca

SEQ ID NO: 12013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagcggggaaaaaggaaaggtccggggcc

SEQ ID NO: 12014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaggaagtggctagggtacgtaacgtggt

SEQ ID NO: 12015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaggcagcaatttgaacgtggtgggcaga

SEQ ID NO: 12016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagggccccgtaggatcttacgctaggcc

SEQ ID NO: 12017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagggctcggagggatctcgcgtgggagg

SEQ ID NO: 12018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcaggggtgcgggcattttgaatcgtgtgg

SEQ ID NO: 12019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagggtcaaattattttctagtataggtt

SEQ ID NO: 12020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagtacgtcgatttattcaaaccctacgc

SEQ ID NO: 12021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcagtcatggcgcgatcacatcaactggcc

SEQ ID NO: 12022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcataacgctagggatccaggttactccgt

SEQ ID NO: 12023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcataagggtgtggttgcagcggttaggcc

SEQ ID NO: 12024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatcactgattaaccactgtctggcggcg

SEQ ID NO: 12025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatcgatgttcgcggtgcttcttgtcata

SEQ ID NO: 12026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatcgcttctttcgttggctgtttgatca

SEQ ID NO: 12027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatgatgggcgcgccactgactaacaaag

SEQ ID NO: 12028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatgcatgcctctcaacccaatacttttt

SEQ ID NO: 12029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatgccagatgcttcttgctggtagtacg

SEQ ID NO: 12030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatggaagcgagaggcttcaatcgttagt

SEQ ID NO: 12031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatggcaaatgttgttctgcgctccttgt

SEQ ID NO: 12032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatggcctcagtttcgctcaatgcgcttg

SEQ ID NO: 12033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatggggcgacctggcttgcattattagg

SEQ ID NO: 12034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatgtacgatatactcaggccggatcctg

SEQ ID NO: 12035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatgttatttggcctctgcctgccggacc

SEQ ID NO: 12036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcattgcggcttgcacactaaggctcgacg

SEQ ID NO: 12037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcatttggcacacggatggccaaacttttt

SEQ ID NO: 12038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccacaatgtacggaacatgccgactcgta

SEQ ID NO: 12039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccacccctgtccacaagcaccggcaaacg

SEQ ID NO: 12040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccacgggttcgtgcagggcataacgccgg

SEQ ID NO: 12041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccagaatacaattggtagtgcacctgttc

SEQ ID NO: 12042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccagcggtgccagttctatgctggttctg

SEQ ID NO: 12043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccagggattttgtatcaggccgttaccat

SEQ ID NO: 12044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccattaaccgctgggatacttctccaaaa

SEQ ID NO: 12045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccacctgcctcagatagacaaattcagt

SEQ ID NO: 12046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccacggtacgcctcgaggagtaatggac

SEQ ID NO: 12047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccagtaggatatagttgcttattcgtta

SEQ ID NO: 12048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccatggcgatgcaacgcattggtggctc

SEQ ID NO: 12049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccccccctggccaggatctgacatttgct

SEQ ID NO: 12050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccgagaggtatatgctatgaatgttggg

SEQ ID NO: 12051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccgatccgtgactcggcgaggcattgtg

SEQ ID NO: 12052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccgatgtgcgcggtttaacgctaaatac

SEQ ID NO: 12053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccgcgcgcagaccatttatccggtaccc

SEQ ID NO: 12054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccggactttcaacagcttcactgctttc

SEQ ID NO: 12055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccggcgaacttcggcatatccgtcgctg

SEQ ID NO: 12056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcccgtgaccgttgatcttagcctgagcgc

SEQ ID NO: 12057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccctagctatgctacaggatatcgggaca

SEQ ID NO: 12058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccctgcccaggttcggaggagttagtcgg

SEQ ID NO: 12059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgacttaaaatctagaacccaggaactc

SEQ ID NO: 12060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgagtcgacgtcacagaggcttactctt

SEQ ID NO: 12061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgcaccgtccttagaacagttcgaatgg

SEQ ID NO: 12062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgcgcgaaagaacgtaagctagagagtg

SEQ ID NO: 12063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgcggagggtatgcgggcacacatcgga

SEQ ID NO: 12064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgcggtaatgaggcccttttcgtgaagt

SEQ ID NO: 12065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgctggctagtttctctcggccacagga

SEQ ID NO: 12066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccggccgtggcagccgtgctggggctgtg

SEQ ID NO: 12067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccggcgtagggatccttgggcgtgtcttt

SEQ ID NO: 12068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccggcttttgagcgcaaattgtgatgcgt

SEQ ID NO: 12069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccggtcttgcttattcagtgctacgtagg

SEQ ID NO: 12070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccggtgtctactccgctttcgctggatgg

SEQ ID NO: 12071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgtctaggagttggaaacatggatgtat

SEQ ID NO: 12072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgtctgacccccgtgccttttacaagac

SEQ ID NO: 12073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgtgctcatatcgtgagaagtgaccagc

SEQ ID NO: 12074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgtggacacgcgagatagctctagtgtc

SEQ ID NO: 12075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgtggctaccggctgctagactgtacac

SEQ ID NO: 12076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccgttctgtttattctcatcaggactgct

SEQ ID NO: 12077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctaagctgggtgatgtgaaaatgtgact

SEQ ID NO: 12078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctacggggcattctcctagccaaggcgt

SEQ ID NO: 12079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctcctaataggacccgttataattgaat

SEQ ID NO: 12080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctcgagtggaaccatgtgtttacgaggc

SEQ ID NO: 12081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctcgtttctaggacttgtcttcttcctt

SEQ ID NO: 12082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctgagggttgtgtagactgtcggtcgcg

SEQ ID NO: 12083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcctgcttcaggccggtatagtcctcttgc

SEQ ID NO: 12084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attccttgtgggcgtccaggcctatgttctgc

SEQ ID NO: 12085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgactcggcaatagtaactgctaaagacg

SEQ ID NO: 12086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgagtatgagagcgttcatgtctcgctcc

SEQ ID NO: 12087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgatcaaaccgccatgcaaatcattctcc

SEQ ID NO: 12088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgatccgtaacaggaagggcacgtgtagg

SEQ ID NO: 12089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgatgcaacctgtcaattgccgggagtaa

SEQ ID NO: 12090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcaccgttagttttcctggttgacggga

SEQ ID NO: 12091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcagatctcagagccgaaacgccacaga

SEQ ID NO: 12092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcagccaccctgcgggaaccgagttctg

SEQ ID NO: 12093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgccaatcggtccctttggcacatatgga

SEQ ID NO: 12094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgccgaggcagttacgcggtgaaatgtaa

SEQ ID NO: 12095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgccggaggttactggatacgtgtgggct

SEQ ID NO: 12096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcctgcagaaaccctgacagggtggggt

SEQ ID NO: 12097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcgaacctcggtggactactccatcaag

SEQ ID NO: 12098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcgatgtgggggtaaaagtgtcgtctgt

SEQ ID NO: 12099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcggatgctcattggcattttcatctcg

SEQ ID NO: 12100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcgggggatgtcgggatgactttgcgtt

SEQ ID NO: 12101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcgtttcccaaaagaggtgcataatttg

SEQ ID NO: 12102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgcgttttttacaaattggccgtctatga

SEQ ID NO: 12103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgctgtgaagtatccgtaacgctggggcg

SEQ ID NO: 12104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggaaggtaaggattgccattgcgcgcgc

SEQ ID NO: 12105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggagagttctgtagtttttattttcttg

SEQ ID NO: 12106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggagcaccagccttaccaagctcgatgg

SEQ ID NO: 12107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcaatggagactgggcggctaccgggt

SEQ ID NO: 12108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcacgttacgtcatgtcgagtggggtc

SEQ ID NO: 12109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcaggtgagaggccaaggtacggcttg

SEQ ID NO: 12110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcaggttatccgccacgggccccttaa

SEQ ID NO: 12111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcatatagtccccaattcgtaaatctt

SEQ ID NO: 12112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggccatgatttcggtctcgcatcgcctc

SEQ ID NO: 12113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggcgtttaatcagagggcatggatggtt

SEQ ID NO: 12114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgggattaaagcgacgttggcagctttcg

SEQ ID NO: 12115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggggaccggaggcgagattatgtctgat

SEQ ID NO: 12116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggggatttcgcgaaggtagctactattc

SEQ ID NO: 12117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgggggaagccgtagacgttcctaatttc

SEQ ID NO: 12118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgggtcctatgccgttccgagtatttggt

SEQ ID NO: 12119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgggtggtgtcattgtactcatcgtgttg

SEQ ID NO: 12120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggtacggctatcaagggagctggtgtat

SEQ ID NO: 12121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggtcgtggctaaggtcgcaggggtgcgc

SEQ ID NO: 12122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggtgatcaaaagagatattcgtgcggag

SEQ ID NO: 12123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcggtggcagatctcctctcgtgttcgtgt

SEQ ID NO: 12124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtaaaaccaagagttatcagctaaatat

SEQ ID NO: 12125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtacgcaagcgcttgcatttggtgcggt

SEQ ID NO: 12126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtagatcacaggccgtagctatgcattc

SEQ ID NO: 12127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtcattgctgtgcagaactataaattcg

SEQ ID NO: 12128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtccgtggctggccctggcgttacgtgc

SEQ ID NO: 12129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtgggcccgatttagtgtaggtgggggt

SEQ ID NO: 12130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtggtggcgtaactcagaaggcaaggca

SEQ ID NO: 12131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtgtaagtggttgtgaaatcggccgtga

SEQ ID NO: 12132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgtgtcgggatctatttcgctcgttctca

SEQ ID NO: 12133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgttagatatcgcaaaacgtgaacttagt

SEQ ID NO: 12134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcgttccctcatttggactctaggaaggat

SEQ ID NO: 12135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctaaagccaatgagtatagcgcacgtttg

SEQ ID NO: 12136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctacatgcccaagctgtggaatacaattt

SEQ ID NO: 12137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctaccgatcgctagaaccggttgcacatg

SEQ ID NO: 12138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctactaagagagatttgccgtggaggtcc

SEQ ID NO: 12139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctagatgaacttgcgcagagccggggtgt

SEQ ID NO: 12140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctaggttagagaggacttgtgaatgggca

SEQ ID NO: 12141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctattaatatcgtcgataatttctgggag

SEQ ID NO: 12142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctcacagctttgccgaccagctcccgaca

SEQ ID NO: 12143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctcactgacacgcccctgttgcatttgtg

SEQ ID NO: 12144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctcagtccgcgcttgattacccatctttc

SEQ ID NO: 12145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctcgtctcgccatcagcttgtgatcaatt

SEQ ID NO: 12146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctctcagtggcatctctcttactagcgca

SEQ ID NO: 12147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgcactgttattgatgtcccgcacgttt

SEQ ID NO: 12148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgcggactgatagtataatgtgggcatc

SEQ ID NO: 12149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctggactggaagtggatcaaacgccgtgt

SEQ ID NO: 12150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctggtacttcctggcttggagtcgcgata

SEQ ID NO: 12151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctggtgatgacgatggctccaagtaccgc

SEQ ID NO: 12152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgtaagactataccgtcaagggattgtg

SEQ ID NO: 12153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgtacattacttcctactcgtggtgtac

SEQ ID NO: 12154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgtcgccttcatgatttaatatgtggcg

SEQ ID NO: 12155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctgtgtttgctcttgattacaccagcacc

SEQ ID NO: 12156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttataactaataggtaaggtgtcaatag

SEQ ID NO: 12157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttattcacctacttttcgcagaggcggg

SEQ ID NO: 12158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttatttagatgcacggcatttgagcaag

SEQ ID NO: 12159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttcctacggacgttcagatactatttgc

SEQ ID NO: 12160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttgcaacccggcggtacgttagtgctgt

SEQ ID NO: 12161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttggatggtttctcgtttacttggaggc

SEQ ID NO: 12162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attcttgggcgcggcaccgtacaaagattgtg

SEQ ID NO: 12163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attctttgcactagtaccagggggacaccccc

SEQ ID NO: 12164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaaacattccttcctgcgaaccggtgctc

SEQ ID NO: 12165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaaccatatgttgatgtatgtaataactc

SEQ ID NO: 12166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaacggatataaaactgcctagtgggcca

SEQ ID NO: 12167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaaggagctccgcgtgtatggatgccgtc

SEQ ID NO: 12168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaatagttcagttctaccttctttatgga

SEQ ID NO: 12169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaatgatctctcctgtctggagttatggg

SEQ ID NO: 12170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaattcgtcactaaggttttcgtcaggcc

SEQ ID NO: 12171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacagtgtctaaagcggcgtcgcctgttc

SEQ ID NO: 12172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacatgacagtactttgtgacacgaagcg

SEQ ID NO: 12173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaccatgctgttagacccagggttataga

SEQ ID NO: 12174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaccgctgatgcctggcgatttcttgcaa

SEQ ID NO: 12175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacctgggctacgctcttgcatcatatgg

SEQ ID NO: 12176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacgagggcgaggaggtcatgatggcttt

SEQ ID NO: 12177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacgcgttgttgggtctgtttgggaaagt

SEQ ID NO: 12178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgacggggtgtgattgattttgctagttta

SEQ ID NO: 12179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgactctattgctgtttattcacatgtcat

SEQ ID NO: 12180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagaaccgttgtgcctataccgcatgctt

SEQ ID NO: 12181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagatgcggcctatccgattttcctctgt

SEQ ID NO: 12182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagcacctgggttcgggatgccgttaccc

SEQ ID NO: 12183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagcaggtaggactgacacgccatgttcg

SEQ ID NO: 12184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagcggggaaggtttaataggcatgtggg

SEQ ID NO: 12185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaggacccccttttttcacaatgcccgcg

SEQ ID NO: 12186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaggtattcattattaatagtcttgtgtc

SEQ ID NO: 12187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgaggttaagccccagctaaaagcaggcat

SEQ ID NO: 12188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagtaagtccggttcggacatgtaccctg

SEQ ID NO: 12189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgagtcatggattggggattgcgggattag

SEQ ID NO: 12190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatagcggtgtcattgttccacttaatgt

SEQ ID NO: 12191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatcaagcgtccattgataagtgagctat

SEQ ID NO: 12192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatcacccgtgcaaatttcaggcccatat

SEQ ID NO: 12193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatcgtcgaaaaatagctaagtttgctat

SEQ ID NO: 12194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatgatggcggggatccgttgttaagtgc

SEQ ID NO: 12195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgattgtcattcgttaatatatgcctaggg

SEQ ID NO: 12196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgatttactgccacgttggctcttgttagc

SEQ ID NO: 12197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcaacgattcatactgcttgtgttagcgg

SEQ ID NO: 12198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcaagagtgcatggtgcttcacggtttcg

SEQ ID NO: 12199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcaaggggctacttctgtgaccactcagg

SEQ ID NO: 12200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcaatgtatacttgtgagcccctgggtac

SEQ ID NO: 12201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcacacttatacggtaatctgaggtacat

SEQ ID NO: 12202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcacaggcgtgtcttgagactacaatcgc

SEQ ID NO: 12203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcacatatcttgacctcgattgggacgtg

SEQ ID NO: 12204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcacgattatgtgccatgggtcaagctca

SEQ ID NO: 12205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcacttaatggccttgaatataaaaacgc

SEQ ID NO: 12206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagacctctggagggatacctccacatt

SEQ ID NO: 12207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagactaactcctggtaaaaataggtcc

SEQ ID NO: 12208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagcaccctttataattcaaattatttg

SEQ ID NO: 12209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagcggaggactggaaagagcccgtatt

SEQ ID NO: 12210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcaggacggaagaccgttagtcaaccggc

SEQ ID NO: 12211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagggcctcgtgtggcggtggttacctg

SEQ ID NO: 12212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcagtaacggtattgcgtttgcgtcagct

SEQ ID NO: 12213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcattctatacttctccggtgatctccca

SEQ ID NO: 12214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcattgtgggtttgagcatcgtatacgtg

SEQ ID NO: 12215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccaaacggttttcacgtccgcgcttgca

SEQ ID NO: 12216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccaaagatgggtaaacagacagcagcgg

SEQ ID NO: 12217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccaatttgaccttgtagcgtcctggctg

SEQ ID NO: 12218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccacacttaacatgattgtggagccact

SEQ ID NO: 12219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccagtgtgtcgacaaattccccgttatg

SEQ ID NO: 12220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccccgatcatccgacctatcagtcgcgc

SEQ ID NO: 12221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccccgtgtcgcccataagcgcgcgagtc

SEQ ID NO: 12222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcccctatcgttttccacgagctgcgcgg

SEQ ID NO: 12223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccctcgtagtcgatgtgttgttggttcc

SEQ ID NO: 12224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccctggtagagggttgtgcattttggtg

SEQ ID NO: 12225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccctgtgctctcgggttggtgtagctaa

SEQ ID NO: 12226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccgaactgagacatcctcgtcgccctcg

SEQ ID NO: 12227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccgcgtcgcatagagtgcccttcgggtt

SEQ ID NO: 12228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccgggttctggcgtatggcgcatggttg

SEQ ID NO: 12229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgccgtgaactaggcaagttccttgttgga

SEQ ID NO: 12230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgaaggaggagttatggcagtacatgac

SEQ ID NO: 12231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgaatcggtgccaaactacgcgaaatcg

SEQ ID NO: 12232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgacgaccccctctatacgtcggagtcg

SEQ ID NO: 12233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgagcgctggtgtcagtcttcgtgtgga

SEQ ID NO: 12234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgaggatccggacagcaaataaatatta

SEQ ID NO: 12235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgatgacattcctttgtagttctttgtt

SEQ ID NO: 12236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcaatgaaagcttgttaaatatttcgc

SEQ ID NO: 12237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcacactcaacgattataccatctggt

SEQ ID NO: 12238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcaggaaggcagttttgtttcaccccg

SEQ ID NO: 12239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcatagaactatatgatatttacattt

SEQ ID NO: 12240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgccacagttcctaggggctattgcagc

SEQ ID NO: 12241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgctgtcgtgaaagttcggaaccactct

SEQ ID NO: 12242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcttagctttcggttcgcgtagcatgt

SEQ ID NO: 12243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgcttgaacatcttaagtcccctgtcca

SEQ ID NO: 12244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcggaaccccggatgtttgattggacact

SEQ ID NO: 12245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcggccgaatttcacttccgatcggacac

SEQ ID NO: 12246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgggcggcggtgtttcgtcactttcgtc

SEQ ID NO: 12247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgggtagataacgtacagctcggtgatg

SEQ ID NO: 12248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgggttgttgccatgcccctcctcttcc

SEQ ID NO: 12249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcggttttgtacctggttacccatcgtgg

SEQ ID NO: 12250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgtgccgttctccccccgtttgcttgtt

SEQ ID NO: 12251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcgttaccagttaacacagtctgcgtggc

SEQ ID NO: 12252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctatagaaccacagggatattttgagtc

SEQ ID NO: 12253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctatcgagacatagagctaccgagagtt

SEQ ID NO: 12254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctcgagggatccgccgatgcgacttacc

SEQ ID NO: 12255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctgctgactgctcaatcgttgtatgcgt

SEQ ID NO: 12256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctggctgttacgggcgggggaaccaacc

SEQ ID NO: 12257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcttaccgtccacagctatagcaacgaca

SEQ ID NO: 12258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcttagaacaccaagggtagttgatgagc

SEQ ID NO: 12259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgcttctgggccctcctttaatgttgtgct

SEQ ID NO: 12260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgctttatctatgcacggaaggggtaatgc

SEQ ID NO: 12261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaagaatcggttatcacagtgtcggaat

SEQ ID NO: 12262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaaggccgctcacatgggcatgcgccat

SEQ ID NO: 12263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaagtcgcggtaataagccttttctgat

SEQ ID NO: 12264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaatgaggaggcgagtatgagccaacgt

SEQ ID NO: 12265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaatggtgactatactgcactcgcgcct

SEQ ID NO: 12266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggacactatgcgttaaaagatcatgcttt

SEQ ID NO: 12267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggacatttgttccgaaagacaaaggcatg

SEQ ID NO: 12268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggaccgattaggcgtggcatggccttaga

SEQ ID NO: 12269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggacgcagcggtctaggtacatcgttgag

SEQ ID NO: 12270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggagagctccacgcagcgctacatacccg

SEQ ID NO: 12271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggagcttcaaggacgcgaggggtgtattt

SEQ ID NO: 12272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggatcaatgtcattatcatcacgttattc

SEQ ID NO: 12273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggatgggcatcgggtatgcagaagtttat

SEQ ID NO: 12274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggatgtgaagttgcgatcactggctctcc

SEQ ID NO: 12275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcacgcaattcacacggtactggggaga

SEQ ID NO: 12276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcactagtgcggtgtgaacccggtcttc

SEQ ID NO: 12277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcattttcggtctgttggagggaggcgg

SEQ ID NO: 12278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggccacagctctgcggcacgctggtgttc

SEQ ID NO: 12279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcccatggttatcgtgcgaactgagcga

SEQ ID NO: 12280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggccgaagagggtattcgacactggaacc

SEQ ID NO: 12281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggccgtaaagcctcagctcgatgctttcc

SEQ ID NO: 12282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcgcttagtttctgccccgcatgacccc

SEQ ID NO: 12283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcgtcgtttcgtaggtgtgaagccacgg

SEQ ID NO: 12284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcgtctcgtgcgtaggggttgtttggcg

SEQ ID NO: 12285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggcgtgtgcatggtcggtaaattatcact

SEQ ID NO: 12286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggctccccgttaagagtacacactcttgt

SEQ ID NO: 12287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggaaggcctgtgggtcacatgtacgtat

SEQ ID NO: 12288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggacaggataagtcgttctccaaggtgc

SEQ ID NO: 12289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggacgaatccattataacgaccgtccgt

SEQ ID NO: 12290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggactttggtgtcgaactcgaagaaagt

SEQ ID NO: 12291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggagcgaggcgacttcaacagtagtctg

SEQ ID NO: 12292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggagcgcgaaccgtgaaagcctgtgtat

SEQ ID NO: 12293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggcagcgaaaccgtgacatgggtggcgg

SEQ ID NO: 12294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggcatctgttgtaacgattgaaagcagt

SEQ ID NO: 12295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggcgagtattcgtaagaagggggctggt

SEQ ID NO: 12296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggcgccagaacttcaaggcggcagcacg

SEQ ID NO: 12297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggggacgttcattcttgtgttgacttaa

SEQ ID NO: 12298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggggactctttctgagcgatggcttcgg

SEQ ID NO: 12299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggggccttcgtggtggtgcatgcttggg

SEQ ID NO: 12300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggggtattagcggttagtgtgcatgtgt

SEQ ID NO: 12301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggtatgcgatcactttctcctttgatag

SEQ ID NO: 12302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggtatgtctgcctgaggcgcgttgaccg

SEQ ID NO: 12303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggtctatggctgctaaaattcacaagtg

SEQ ID NO: 12304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggtgcgtgctaattgcttctgtaggtcc

SEQ ID NO: 12305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggttaccaacttcttatttgatctttcg

SEQ ID NO: 12306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgggttggtaccgtcgctttgcttggatga

SEQ ID NO: 12307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtacgggatactaagccccacactatcg

SEQ ID NO: 12308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtagccgtgaccagaagtcgaagttggc

SEQ ID NO: 12309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtagttcccagtcccagtgtaatcacct

SEQ ID NO: 12310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtcacgcgagccactataggtaatgccg

SEQ ID NO: 12311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtcccatcaatgacgaaagttacaaggt

SEQ ID NO: 12312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtccgttcaaaggctttttcgcctagct

SEQ ID NO: 12313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtcgcgatcgaggcgggtagctgttagg

SEQ ID NO: 12314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtgcataaacccggcactgtagcagcgg

SEQ ID NO: 12315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtggcgtgtttcccgggttgcaatggtc

SEQ ID NO: 12316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtggtggtctttatgacatcacgtatca

SEQ ID NO: 12317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtgtaagcgcggtgcgactaacaaagta

SEQ ID NO: 12318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attggtgttgcgggtttatagtttttccctta

SEQ ID NO: 12319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtaaagctggctggtcgggggtggccggg

SEQ ID NO: 12320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtaacgccgcttgccggtctttggccatt

SEQ ID NO: 12321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtaagcaaatacactgacatttggttcac

SEQ ID NO: 12322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtaatacgacaatgcccctgctgcattgc

SEQ ID NO: 12323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtacgttggctagggctatccaaggaacc

SEQ ID NO: 12324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtagagtcgaccgcgaatgtcgcagtttg

SEQ ID NO: 12325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtaggcactcacttccttagatgccccga

SEQ ID NO: 12326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtagtcatatctccaggtattgtcaacac

SEQ ID NO: 12327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtagtctatgccataggtttgtttaatcg

SEQ ID NO: 12328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtatccaatgaggcacacgtttcgcgccc

SEQ ID NO: 12329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtatctctcaacgatatcacagacccggg

SEQ ID NO: 12330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtcagaaggcgcagcgtcgaggttgctcg

SEQ ID NO: 12331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtcatttttgcccctcggtgataggtaat

SEQ ID NO: 12332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtccacgttgttgatgccattcctgaagg

SEQ ID NO: 12333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtccgctgtgatcccaaagagggtgctgc

SEQ ID NO: 12334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtcgcatgggtccctggtatcgtttgctt

SEQ ID NO: 12335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtcgggttgccgaaccttttctaagcgcc

SEQ ID NO: 12336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtctgacggacgacttgaattgcgtaatg

SEQ ID NO: 12337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgacagcgcgttctctaagattgctagg

SEQ ID NO: 12338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgaggagacgtgatttttgcgacggtcc

SEQ ID NO: 12339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgcgatggtgcagagagcctggatgtct

SEQ ID NO: 12340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgctgatgccacgtgcctggtcccctag

SEQ ID NO: 12341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtggactagccgaaaggccctgcgaccgg

SEQ ID NO: 12342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtggagcagtgttgaccgcgttagtaact

SEQ ID NO: 12343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtggggtggtgacctttgttatggatttg

SEQ ID NO: 12344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtggtgcttctcgctgcgatggctcaccc

SEQ ID NO: 12345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtggtttcgtgcaggaatctgtctgcatc

SEQ ID NO: 12346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgtacgtacattccttgggacggaatcg

SEQ ID NO: 12347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgtcccgggattcggtcaatgtgtagtt

SEQ ID NO: 12348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgtctatcctgcgctttggctatccacg

SEQ ID NO: 12349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgtggttacagataaccgtgcttatcgc

SEQ ID NO: 12350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgtgttgtgatagatcggaggaaagttgcg

SEQ ID NO: 12351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttacgcctgccactaaactagggtgagg

SEQ ID NO: 12352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttacgtttgtaccagtgagaacatagtt

SEQ ID NO: 12353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttaggtcatcatatatattcatctcggg

SEQ ID NO: 12354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttcgttatggatcggctctgtagggtta

SEQ ID NO: 12355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttgattctctgcttcatgtgggatctag

SEQ ID NO: 12356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttgcttggcagagtgcttttaccaagta

SEQ ID NO: 12357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttggaaggtgattctgtcctgtgtgtgg

SEQ ID NO: 12358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttgtggttcccctttctcgagggccaag

SEQ ID NO: 12359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttgtttagaatagtaaatgctagggggg

SEQ ID NO: 12360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attgttgtttcgataatagctcgaccctcgaa

SEQ ID NO: 12361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaaagtcaagtttatggtagcggagggta

SEQ ID NO: 12362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaaccaattttcgcctatactttacgttt

SEQ ID NO: 12363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaaggcattctctggcaggattatcgcgt

SEQ ID NO: 12364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttacagctggctatacatctatgaccttcc

SEQ ID NO: 12365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttacagtttgcgtcctagtagaccgtgttc

SEQ ID NO: 12366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaccataactcggctggttcctgtctttg

SEQ ID NO: 12367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaccggcactgtttgaagtcagctatact

SEQ ID NO: 12368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttacgggcgatcaagtccgggacgtaaaac

SEQ ID NO: 12369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttacgggcgtgggggccttcacggttggtc

SEQ ID NO: 12370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttacggtgcttctcaatcttaagctttggc

SEQ ID NO: 12371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttactcggtctggcctgaacattgctcccg

SEQ ID NO: 12372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttactgaggtgagacctctattgttggata

SEQ ID NO: 12373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagattgcacaccggcttagagaagtcac

SEQ ID NO: 12374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagcagcatcagagtccctgttgttgatc

SEQ ID NO: 12375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagccaccggattcaccgtcctccggcga

SEQ ID NO: 12376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagcgccttggcttgccttgtctatggac

SEQ ID NO: 12377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagcttaggtaacacgcagcgtaatgttg

SEQ ID NO: 12378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaggagcaatgagattgtaatgactgagc

SEQ ID NO: 12379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaggcttcgtgatcatggcagatttcccg

SEQ ID NO: 12380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagggcggccaggccaaagttattccgtc

SEQ ID NO: 12381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaggtaggagttgacgtgtgtgtgttgcc

SEQ ID NO: 12382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttaggtcgtcggtcgcttccagatatatta

SEQ ID NO: 12383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagtccaattgtcccacagtgatcttctc

SEQ ID NO: 12384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagtccggagttgcggtaaacccggtggg

SEQ ID NO: 12385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttagttaaggcacattatatttcgatgcat

SEQ ID NO: 12386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttatcagactccgtgattgggattatggaa

SEQ ID NO: 12387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttatggcaatgttttagtccatccgatctt

SEQ ID NO: 12388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttatgtagtctcttccgtgatgataattgg

SEQ ID NO: 12389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttattccataaactctccgccctccgtgcg

SEQ ID NO: 12390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttattggcgctcggtcacataaggtcgcgg

SEQ ID NO: 12391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcaaaaagactggggcggacaggggtcgc

SEQ ID NO: 12392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcaaaggatgttaaatattcaccctatgc

SEQ ID NO: 12393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcaaccgcgacaagggagctaggtgtggg

SEQ ID NO: 12394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcaatggacagtcatgacgtctcccgatc

SEQ ID NO: 12395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcacgattggtggagcatcgcgagaactt

SEQ ID NO: 12396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcagcgtgaggttggcataattggctgtt

SEQ ID NO: 12397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttccacgcgaacgtagggtttcccagctat

SEQ ID NO: 12398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttccactcctttggtgatccacattgatgt

SEQ ID NO: 12399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttccataagcatgcgtgtgccaaacgtagc

SEQ ID NO: 12400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttccatgttgcggtgtctactgaacgtggg

SEQ ID NO: 12401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttccgttgcttggcgactggcttgcatgtg

SEQ ID NO: 12402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcctccccaactatatggcttttgaggca

SEQ ID NO: 12403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcctgcacgggtggcgctcggcggttaga

SEQ ID NO: 12404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcctgctctgcttgctttttaccgggtac

SEQ ID NO: 12405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgattgcaatactgtcctgttgccgcgg

SEQ ID NO: 12406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgcatatacgggacgcggcggccctgta

SEQ ID NO: 12407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgcctggctgtttctttctagaggcaga

SEQ ID NO: 12408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgctcacttaagctggatcggaacaatc

SEQ ID NO: 12409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggacactagtgtctcggaaacgttcgc

SEQ ID NO: 12410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggacactcaccgtcatgttcctggcac

SEQ ID NO: 12411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggatcagggggcaacgcatcctacttg

SEQ ID NO: 12412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggctgtatcagcgcttaaccgatcagc

SEQ ID NO: 12413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgggcgcagggcgtcaagacttgacccg

SEQ ID NO: 12414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggggaccggttcgcacgcttagcatag

SEQ ID NO: 12415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggggattccagttaatcctggagacga

SEQ ID NO: 12416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgggtattttggaagtttgtcttttata

SEQ ID NO: 12417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggtgctgcaagcttcatgtcacagggt

SEQ ID NO: 12418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcggttgagttaagtaacctctatgcgta

SEQ ID NO: 12419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcgtgtggtattttggcttgaccttacac

SEQ ID NO: 12420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttctaattgacgcccgtccgccttgggcag

SEQ ID NO: 12421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcttcatcgctcggcacggttgcaagccc

SEQ ID NO: 12422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttcttgcaagtgttttggggccgctgtgat

SEQ ID NO: 12423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgacaaagttccccccagtcgtcacgata

SEQ ID NO: 12424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgacacgagcgtgctccaaagtcatatgc

SEQ ID NO: 12425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgactcaagaggtgttagtcccatttcct

SEQ ID NO: 12426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgaggcttaatgtttcgtcccgttccgct

SEQ ID NO: 12427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgcaatcagaatcgcggcgctggcatttt

SEQ ID NO: 12428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgccgtctgatgggggtcttcggctctga

SEQ ID NO: 12429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgccttgggatgaagcctctatgcaggcg

SEQ ID NO: 12430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgcggaaacctggtacaacctcaagcgtg

SEQ ID NO: 12431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgcggtggttcaaggatcgtgattttttg

SEQ ID NO: 12432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgcgtcacaaggcattttacctaccatct

SEQ ID NO: 12433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgcgttcacgaggaactggattatacgtt

SEQ ID NO: 12434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggaacagctacggatttgaggcccgctg

SEQ ID NO: 12435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggaatagggtctgggttgtcgcatatgg

SEQ ID NO: 12436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggaggcaccagattacttacaagacccg

SEQ ID NO: 12437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggaggcttcaggccaattggtgtccaac

SEQ ID NO: 12438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggatctggttgcactcgtcagatactga

SEQ ID NO: 12439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggatgaactatagccctaccgcgttgaa

SEQ ID NO: 12440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggcaatgaggacaagaggctggctcgta

SEQ ID NO: 12441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggcagctacatattcatccgacggtcca

SEQ ID NO: 12442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggcggccagcacggtttctcagaatgcc

SEQ ID NO: 12443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggcgtgaatcggacggggatctaggcta

SEQ ID NO: 12444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggctgtacggcctaaattgaaccgttat

SEQ ID NO: 12445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggggacagttattcgtacaggtcggatt

SEQ ID NO: 12446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggggcggtcacagcagcatctccagttg

SEQ ID NO: 12447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggggtactgaactttatacttcgagttt

SEQ ID NO: 12448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgggtggccactctttgccaatatatgcg

SEQ ID NO: 12449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgggtgtgctaagctagtttctctcagcg

SEQ ID NO: 12450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggtccttgactatatgtctcgtataggg

SEQ ID NO: 12451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggtcggatcaggtgatgctcctctatgg

SEQ ID NO: 12452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttggtggtgttcgtggattggaggaggtgc

SEQ ID NO: 12453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtcaacgaggcggggttcatctccgggc

SEQ ID NO: 12454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtcgaactacgacttcggttaacgtgcg

SEQ ID NO: 12455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtcgacgtcatcactagctgcaggtgtg

SEQ ID NO: 12456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtgaggggattagatctacgtcgtcggc

SEQ ID NO: 12457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtgcctgatgcagatcgaacgagtatta

SEQ ID NO: 12458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtgcttacgcggtgcaacagacctagtc

SEQ ID NO: 12459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtgcttcccttggttatatcgttcaagc

SEQ ID NO: 12460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtggcgactgagtccagaggttaatgcc

SEQ ID NO: 12461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgtgggaccttttagatagcggtatattc

SEQ ID NO: 12462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgttatcaagtgctagatgcaaggctatc

SEQ ID NO: 12463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttgttttcttgcgattgacaggaccgcgta

SEQ ID NO: 12464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttaaagttatgtctccggtctcaaggggg

SEQ ID NO: 12465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttaaggaagcggatgtcttactgtgcgta

SEQ ID NO: 12466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttaatcacttctgtattccccgcgtctgc

SEQ ID NO: 12467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttaattggtgtatcccgggcttggtacta

SEQ ID NO: 12468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttagtgcgcttcgcctgcggattgtatca

SEQ ID NO: 12469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttataatgtgacactcgtcggactgatag

SEQ ID NO: 12470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttatatgtgcatcacccccgcttcggtcg

SEQ ID NO: 12471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttcatacagtcgcgacacctggaccgggg

SEQ ID NO: 12472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttcatccgtacgtccgtatatgacgtttg

SEQ ID NO: 12473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttcccaactttgttacgggtaaccgcacg

SEQ ID NO: 12474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttcctgctttgttctagtaagattgcgac

SEQ ID NO: 12475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttcgtctcgcgtggcctcatttccagggc

SEQ ID NO: 12476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttctccggattctaggttagcctatcttg

SEQ ID NO: 12477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgacctgggggtgtatcgccggtttttc

SEQ ID NO: 12478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgacgcaggctgagtgctatgagtgctg

SEQ ID NO: 12479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgagagtttacgccttgaagtgggtgtt

SEQ ID NO: 12480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgatgggggcggtgataacctatgagga

SEQ ID NO: 12481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgatgttagttgcctcaacgatcttcta

SEQ ID NO: 12482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgcacacatgtgacagttcccccagtgg

SEQ ID NO: 12483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgcctacagtaacagacccagttaaggc

SEQ ID NO: 12484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgctaaatttgtcacttgcggagtgatg

SEQ ID NO: 12485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttggacaccgtatatcttaatctgtatct

SEQ ID NO: 12486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttggcagggcgaacgatcacttatctgcg

SEQ ID NO: 12487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttggctcaatagagactcagagtgcggcc

SEQ ID NO: 12488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgggcaggtcacggattctgtaaggccg

SEQ ID NO: 12489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttggttagaccttgactgaagggcctgtc

SEQ ID NO: 12490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgtccatagatacgctccgtaggccctc

SEQ ID NO: 12491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgtgttcctgctatgctgtgtacggctg

SEQ ID NO: 12492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttgtttaaaaatttcatggctgattctgt

SEQ ID NO: 12493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttttcacatcgacggctgcggcaggttaga

SEQ ID NO: 12494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttttcccccaaggtgcgtggtctacgtctt

SEQ ID NO: 12495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
atttttgcgataactcttgtcgtgtgtatcca

SEQ ID NO: 12496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
attttttgtcacttcgatctgcgttgatagga

SEQ ID NO: 12497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaaacatgtgtgcgcgccgtggaggttgc

SEQ ID NO: 12498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaaagcttgttcttaaattgccgtggttc

SEQ ID NO: 12499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaaaggcgaaacgtagtccggatgatgag

SEQ ID NO: 12500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaaatggcagggggattacttgcacgaat

SEQ ID NO: 12501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaacgcgaatgagttctttcgccgggaaa

SEQ ID NO: 12502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaagacagggtctcggagacgatcgcctc

SEQ ID NO: 12503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacaaacaccaacggatcgatggaggcgt

SEQ ID NO: 12504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacaagtgtgcagcgctgacggggtctgg

SEQ ID NO: 12505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacaatagcaaaaggcgcgttctgtctgt

SEQ ID NO: 12506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacactcgacagcaaaggttcacggggcc

SEQ ID NO: 12507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaccgggaacgccgatcgaagtcagctgc

SEQ ID NO: 12508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacgaccaccgaacatgcaggcgaacacc

SEQ ID NO: 12509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaacgtgcaagatcggtaaggtcgactatt

SEQ ID NO: 12510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaactcataataacacaaccgtcaaccgcc

SEQ ID NO: 12511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagaaccgctgaggtagtttctcacaaag

SEQ ID NO: 12512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagagaacccaccggtgaccaaggaattc

SEQ ID NO: 12513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagagcgtgtattccattggactcagtta

SEQ ID NO: 12514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagcgtgatgtgaccctaaagcgcagggg

SEQ ID NO: 12515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagctaatctgggtgttaagccaggatgg

SEQ ID NO: 12516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaaggtgggaactagctcggtggggattgg

SEQ ID NO: 12517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaagttccccaccagggtcttcccatgaga

SEQ ID NO: 12518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatatacgtcaagttctattatcccacgt

SEQ ID NO: 12519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatatccggtagacttgcggttgatgccg

SEQ ID NO: 12520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatatgagagtgaaaagctgtggacattt

SEQ ID NO: 12521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatcggcttaaccccatttgcatggcttg

SEQ ID NO: 12522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatgagcataatcgattacttaggctatc

SEQ ID NO: 12523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatgcatgggctttctggtcacgttgatc

SEQ ID NO: 12524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatggcatagcgtgaatcatggtttcaac

SEQ ID NO: 12525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatggggtacgggagctgttttcgcaagg

SEQ ID NO: 12526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatgtgtaccgtcacattaaaagtggcgc

SEQ ID NO: 12527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaattccgtaatttaggaacctccgcagcg

SEQ ID NO: 12528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaattgggataggtgtgatatggacttttg

SEQ ID NO: 12529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaatttggctttttcttgcggggctcctca

SEQ ID NO: 12530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacaaccgatactgctatatttaaagttgg

SEQ ID NO: 12531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacacaagggaaaaatgtgccctactgtag

SEQ ID NO: 12532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacacacttagctccgtctgcaggacgatc

SEQ ID NO: 12533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacacgcacacgctttcgaggaattcgtcc

SEQ ID NO: 12534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacactcttttagaaagtctactgtgtata

SEQ ID NO: 12535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacaggcatgctaagacggtacgcgtcgac

SEQ ID NO: 12536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacatgatttctggcttataagggatcaat

SEQ ID NO: 12537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacatgcaatagtcgcgggtagcccgttcg

SEQ ID NO: 12538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacatggggaggaaagaagccatacgcggc

SEQ ID NO: 12539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacatggtcgcagcgcaggggataaacgga

SEQ ID NO: 12540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacatgttacggcatggcatacggggtgcg

SEQ ID NO: 12541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccaaacagagaggcgccttcgatccacc

SEQ ID NO: 12542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccaaagacaagctctattacggcgcagg

SEQ ID NO: 12543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccaaggaccgcgactcgtgcccggggat

SEQ ID NO: 12544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccatatcgaaagtttagagacccagtag

SEQ ID NO: 12545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccatcgttgattacataatgcgccgatc

SEQ ID NO: 12546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccccgtgtgtctacgtgctgccataagg

SEQ ID NO: 12547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccgacaggttggatatggacacgtacct

SEQ ID NO: 12548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccgatccacagttaattcctccttcctt

SEQ ID NO: 12549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccgcgaggcctccatatacctggtacgg

SEQ ID NO: 12550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccgcgcaggtggtgtttcggcgcaagat

SEQ ID NO: 12551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccgtaagttcctcacgtgtatcacgtgc

SEQ ID NO: 12552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacctacagcggtggcgattgctagtaagc

SEQ ID NO: 12553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacctagactttgttaccaacgccgtagtg

SEQ ID NO: 12554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacctcggaagtctggtttcttccatctcg

SEQ ID NO: 12555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacctgcaattggtgaagttggttcacgtc

SEQ ID NO: 12556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaccttagttaggcagtcgagcgttgcgct

SEQ ID NO: 12557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgaactttcggcatcggtgactgcgctc

SEQ ID NO: 12558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgagaaggttacaacgcgctggaccacg

SEQ ID NO: 12559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgaggtcctttatgtaggggacgattga

SEQ ID NO: 12560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgagtacgctgccgatggggtgcagtgc

SEQ ID NO: 12561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgcagacacggactcgggctatggctcg

SEQ ID NO: 12562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgcgcgtgacatcaggtgcgtggcgacg

SEQ ID NO: 12563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgctaatgggttcccctcccgcgagtct

SEQ ID NO: 12564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggagagttgattggcaggccctcgctt

SEQ ID NO: 12565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggagctaatgcaccccggctcggcata

SEQ ID NO: 12566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggctcgggggttccatgctacgggagt

SEQ ID NO: 12567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggggttgtggcacaagcgttcgagtgc

SEQ ID NO: 12568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgggtggactgtcacaaggagtttggcg

SEQ ID NO: 12569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggtatttgcgcaccgccgggcttcagt

SEQ ID NO: 12570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggtcaatgtacttcatgctatggtatc

SEQ ID NO: 12571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacggtcgcaacgcgtactcgcaacgctgg

SEQ ID NO: 12572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtaagtacgggcgcgtgggtcctcggt

SEQ ID NO: 12573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtagcacttgtaggccacactcgcccc

SEQ ID NO: 12574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtagcaggccgaacgaattctagccct

SEQ ID NO: 12575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtcatggcccttcgagtgctgggggag

SEQ ID NO: 12576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtggaagcccgtccttgctgtggtaag

SEQ ID NO: 12577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtggacgttggaaatttaagcgcacga

SEQ ID NO: 12578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacgtttcgttggagaatcggctcgcttgg

SEQ ID NO: 12579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactaaacacgtactaggttgaatgcagcc

SEQ ID NO: 12580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactaacgtggaaggctcgggtcccggtgc

SEQ ID NO: 12581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactaattctccattatggaagtctgggca

SEQ ID NO: 12582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactcactccggcgatattgaggtttcgtg

SEQ ID NO: 12583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactcattgagaaaggcgatctccacagca

SEQ ID NO: 12584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactgacgatgggtgtgggaatggtacccc

SEQ ID NO: 12585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactgagacggttctcgagcgaggactggg

SEQ ID NO: 12586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactgcagtccaatcggcgtgcttgttggt

SEQ ID NO: 12587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactggaccaggatgacgggcacggaggtg

SEQ ID NO: 12588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaactgtagttaggaccggcgccgtcctatt

SEQ ID NO: 12589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaacttattttgatggctaagctgtgcgcgg

SEQ ID NO: 12590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagaacatgtgtgtttgtcgtgttgatgtt

SEQ ID NO: 12591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagaagtgcttttccgacatccagtgcggg

SEQ ID NO: 12592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagacagatgtgcacatgccgccggtagtg

SEQ ID NO: 12593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagacaggcacgtgctccactaagataaag

SEQ ID NO: 12594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagacgagggcaagacgtttcttcgatgac

SEQ ID NO: 12595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagacgggatgctatattactctctggttg

SEQ ID NO: 12596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagagagggtacggtgttacggaccatggg

SEQ ID NO: 12597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagaggattcgaagtttccttgcatagcgg

SEQ ID NO: 12598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagataaggcgcacgagtgctaatccaccc

SEQ ID NO: 12599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagatgttttatcgcgcttgcttcggaagt

SEQ ID NO: 12600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagattccttgcctaacaatttttcatgtc

SEQ ID NO: 12601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcacaggcaaacgtagacagagttcaat

SEQ ID NO: 12602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcacgcgtgtaggggcgaaaaggtttgc

SEQ ID NO: 12603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcactgcgggtcatgtcaagtacgtggg

SEQ ID NO: 12604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcagagcaggtccgttcagtcggttttg

SEQ ID NO: 12605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcagcccgactgtttattgaggatcatc

SEQ ID NO: 12606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcataagcataagtaccagtgtagtcta

SEQ ID NO: 12607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcattggatcgagtgaggagcccacaaa

SEQ ID NO: 12608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagccagccgaaatcccttgccacgtctcc

SEQ ID NO: 12609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagccatgggcaaacaactattgtagcgca

SEQ ID NO: 12610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcccgatacgattagatgtatgctggcc

SEQ ID NO: 12611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcctgattccttacaagccgtcggtcaa

SEQ ID NO: 12612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagccttccgggtggtcggtaattaagaca

SEQ ID NO: 12613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcgagctctcgaccgggccccctcttgc

SEQ ID NO: 12614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcgtagcctcgacaccgcccaaagggtg

SEQ ID NO: 12615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagctccctcggtaagatgtccgggagcga

SEQ ID NO: 12616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagctgaccggtaaaagcgtgtataaccgt

SEQ ID NO: 12617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagctgtatactgtctttctttcagatgtg

SEQ ID NO: 12618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagcttggagcaccaatggggacgcgcgtc

SEQ ID NO: 12619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggaacggctcagttgtatggacgcaggg

SEQ ID NO: 12620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggacggaaaaggttgacgctattgaacg

SEQ ID NO: 12621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggacgttggaaggtctccgatcagaatg

SEQ ID NO: 12622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggagcgggtgagccattagtcgccccgg

SEQ ID NO: 12623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcaacggtgaaactgggggtcgtcagg

SEQ ID NO: 12624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcatctaagcacgaggccctgaaggca

SEQ ID NO: 12625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcgctgttaccctgagcatgagcacgg

SEQ ID NO: 12626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcggaacgctgctaaaagtttgtggta

SEQ ID NO: 12627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcggtctggtgtcgtctcctgtgcgag

SEQ ID NO: 12628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggcggtttcatatttgttaattgcggat

SEQ ID NO: 12629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggctataaacaagggcaagtcggcaggg

SEQ ID NO: 12630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggctccctgtggtaactctttgaggacg

SEQ ID NO: 12631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggctctcacgccttgtgtatgctacgcg

SEQ ID NO: 12632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagggccacagtttctacgcgctttattct

SEQ ID NO: 12633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagggggctaaggtcctgtacgtcagcttg

SEQ ID NO: 12634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagggttccagtgtgtgttgtcgatagaga

SEQ ID NO: 12635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagggttggggagtccgtagaagggcggtc

SEQ ID NO: 12636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggtccatgtaagggtgccagattgctgt

SEQ ID NO: 12637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggtcgattcaccatacagattacagtgg

SEQ ID NO: 12638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggtggccggtcattatctacggctggga

SEQ ID NO: 12639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaaggttgccgggtaaagaggtgcgtacggg

SEQ ID NO: 12640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtacagattgacgccagtcgttagcaag

SEQ ID NO: 12641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtaccactgccggagcccactgccttcg

SEQ ID NO: 12642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtagcatcaaatggtcggtcccgttaat

SEQ ID NO: 12643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtaggatctccgctgcctcagccaattt

SEQ ID NO: 12644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtagtattgtgggtcctgactgacaccc

SEQ ID NO: 12645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtagtcggcaaaaggcttgcagtgtgtt

SEQ ID NO: 12646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtccgtcgagtcattgtgatcaccgtcg

SEQ ID NO: 12647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgaagctccttatcaaccgccgggaaa

SEQ ID NO: 12648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgaattacggcgtttgggcgggcgtgg

SEQ ID NO: 12649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgagacgccgcgcgaccggacgtcccg

SEQ ID NO: 12650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgatcccagtagcatgctaggatccga

SEQ ID NO: 12651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgattgtggagacgtgctcgttacgta

SEQ ID NO: 12652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgcgatttggcagtccgctctgtaggc

SEQ ID NO: 12653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtggaactaaccaggtgtcgagtcgagg

SEQ ID NO: 12654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtggcacaacgttaatatgtcgcccggt

SEQ ID NO: 12655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgggggtgtcgagttggacttgtgttc

SEQ ID NO: 12656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtgtttcaataagggacagcttttgagt

SEQ ID NO: 12657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttaacgtgtacgggggctacgcgtcaa

SEQ ID NO: 12658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttacatcgctgatcggcatgaatcggg

SEQ ID NO: 12659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttacatctagcggggaacgggtttgtg

SEQ ID NO: 12660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttcaccgtgttcgtaatcgtttctcgg

SEQ ID NO: 12661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttcacggaaatttggttgtgtggcagt

SEQ ID NO: 12662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagttgtgggtggagggagacaatcggccc

SEQ ID NO: 12663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaagtttagcgatcctggggttgagcggtca

SEQ ID NO: 12664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaataaaacaacttggttctagctttgcgtg

SEQ ID NO: 12665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaataagacttggactccattcgtagatggc

SEQ ID NO: 12666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaataagcggctgcgtacccttaactgcgta

SEQ ID NO: 12667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaataatacgggaaaatcgctcttggttggt

SEQ ID NO: 12668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaataccgcaaaggtatgtccctatggcccc

SEQ ID NO: 12669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatacctggaggtatagcgtgagggggccg

SEQ ID NO: 12670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatacggacgctacgtatagtgtgtttggt

SEQ ID NO: 12671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatactatcccatgctcattcattcgtagc

SEQ ID NO: 12672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatactgttttccggcagcttttatcgtct

SEQ ID NO: 12673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatacttagtaggagggctagcgcacaacg

SEQ ID NO: 12674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatagaatggaagcttcgatgaaccaagcg

SEQ ID NO: 12675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatagcgcttctcgatatcatgcatccctc

SEQ ID NO: 12676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatagcgggcgccaattgctccgatagcgg

SEQ ID NO: 12677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatataagacttcaccaaaagtaaatagcc

SEQ ID NO: 12678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatatcattccgagcttattatctgatggc

SEQ ID NO: 12679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatatcctatatcggcggtacgttaatttc

SEQ ID NO: 12680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatcactggcgaaagatctacaccttggta

SEQ ID NO: 12681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatccaaacccacagttgggacctccggca

SEQ ID NO: 12682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatccccgatgctgcgggcacccggcatag

SEQ ID NO: 12683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatcctagaggtgcgggcttcttgggtcat

SEQ ID NO: 12684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatcgagtggctatccaggcagtgtaggca

SEQ ID NO: 12685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatcggccgttgacgtgtgaggcgcacgtg

SEQ ID NO: 12686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatcggttggtgtcccctacccttatagta

SEQ ID NO: 12687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatctagtgcggcgaaatcgtgcgggcccc

SEQ ID NO: 12688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgacccgacacgagccacaatcggttgg

SEQ ID NO: 12689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgactaggttgggtggccaggcaatcgc

SEQ ID NO: 12690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgactgttcgtttaacaacggtcaggag

SEQ ID NO: 12691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgagtgtccgatgtttgatgccgagagc

SEQ ID NO: 12692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgcaaactaagccgtaattgctcagtcc

SEQ ID NO: 12693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgcagaacgctgactaataatgcaagtg

SEQ ID NO: 12694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgcatcttggggttacgagacgttttga

SEQ ID NO: 12695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgccggggtctttgctgcacatcggttg

SEQ ID NO: 12696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgctcaacttgatccagtgcatgtttag

SEQ ID NO: 12697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatggatggtgactcggtcctttcgctgtt

SEQ ID NO: 12698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatggctgtgtgcaagtcggtgcgaggtgc

SEQ ID NO: 12699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgggtggtcatccgatcgccatacatcg

SEQ ID NO: 12700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatggttttcgttccgccggaggaatacac

SEQ ID NO: 12701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgtggtgagttggttcatgatgtgacca

SEQ ID NO: 12702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgtggtggagtgacctctagtcagtaag

SEQ ID NO: 12703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatgtttctgggtgaaaattcttccctcat

SEQ ID NO: 12704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattaacgcagctgtgtggacccgtcaccg

SEQ ID NO: 12705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattaacgtagctgttccgtcggggtggtc

SEQ ID NO: 12706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattacgctcactgggtttaggccgccgat

SEQ ID NO: 12707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattccggggttaatttcgatcattttggg

SEQ ID NO: 12708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattctgagtgaaagtcggaacataatgcc

SEQ ID NO: 12709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattgtcccccggtggtgtattgcgaggtt

SEQ ID NO: 12710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattgtcctactttggaaccaactacgtac

SEQ ID NO: 12711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatttacctgatcgtatacacacagctacg

SEQ ID NO: 12712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatttctcgacaggcccaggcagaaccgcc

SEQ ID NO: 12713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaatttggtgtggtaccaaaattcgatctcg

SEQ ID NO: 12714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaattttgaggctgtcgaattttagctcgga

SEQ ID NO: 12715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaaaacagagtatggacgctttggtgtt

SEQ ID NO: 12716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaacaaactgattgtctttcccactagc

SEQ ID NO: 12717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaacaggcggcacattcactggtgggta

SEQ ID NO: 12718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaacgatttgatccggggcacctggacg

SEQ ID NO: 12719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaagagcgctgcatcacaatgtcatgat

SEQ ID NO: 12720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaattattaaccttttttaactccagct

SEQ ID NO: 12721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaacacaccatgctccggtgcaatgaatt

SEQ ID NO: 12722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaacatctgtgaataggagcgctccgaca

SEQ ID NO: 12723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaccctcttgtttggtaccttacatgtc

SEQ ID NO: 12724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaacgccgaggtagcacattgggcttggg

SEQ ID NO: 12725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaactgcataggttccgtaagtacatgcg

SEQ ID NO: 12726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaagcacaatgcaaggggtatcccgcccg

SEQ ID NO: 12727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaaggctttggtgcaagcctatcgcgcga

SEQ ID NO: 12728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaatattaggaattaaataacgttgaact

SEQ ID NO: 12729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaatccgcccatgatcgtcatgatcgtgc

SEQ ID NO: 12730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaatgggaggcgcctctataggggtctgg

SEQ ID NO: 12731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaatggtattatacgctatattctcggca

SEQ ID NO: 12732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaatttgtctctattatgtactaacctac

SEQ ID NO: 12733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaattttgattctttgtagtcttgggtcc

SEQ ID NO: 12734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacaaacgtcgcttgacgaggtgcagtgg

SEQ ID NO: 12735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacaatagggcgcatggaagcggcatccg

SEQ ID NO: 12736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacaccggactcggaagggacactccttg

SEQ ID NO: 12737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacacgcccgaccgatcgctcataggcgg

SEQ ID NO: 12738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacagcccggactgtcctgtttcaatctg

SEQ ID NO: 12739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacagcggagtgtgcgtctaggcgaaccc

SEQ ID NO: 12740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacagttggtgggtctcggctacccgagc

SEQ ID NO: 12741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacataacactgtagtgaggaatgagtgc

SEQ ID NO: 12742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaccaccttaatgtcgtttatcgtacgcc

SEQ ID NO: 12743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaccgaatcagtagcccggcaccccagct

SEQ ID NO: 12744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacgacacctgatgtgtgttcactccgcg

SEQ ID NO: 12745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacgtgaacttagctgttaatggtttatc

SEQ ID NO: 12746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacgttacttggccaaactactaggttgt

SEQ ID NO: 12747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacactcgcgcgagtgccccgattacggtgg

SEQ ID NO: 12748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacactggcgggatcagtcccacagctaccc

SEQ ID NO: 12749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacacttttcccactaggttaacgaggttcc

SEQ ID NO: 12750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagacatccgttgcaacgggcgattcggc

SEQ ID NO: 12751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagagaaagcacgatatccgttgaaggag

SEQ ID NO: 12752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagccatccaagatgtgcaccatacggaa

SEQ ID NO: 12753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagcccacggccaacccacacccaacatg

SEQ ID NO: 12754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagccgagcgccatagaaacttgttacta

SEQ ID NO: 12755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagctcgacgagattcttgcgacatcggc

SEQ ID NO: 12756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagctctcgggcttgtgtggctgtagacg

SEQ ID NO: 12757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagctgatggtgacagggactggttcccc

SEQ ID NO: 12758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaggctgcgtgcggattaaggcccggtgc

SEQ ID NO: 12759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagggcacgtgacctgatggtggggggat

SEQ ID NO: 12760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaggtggttcgcactatctttgttcattg

SEQ ID NO: 12761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacaggttcatcttgtcgctcttctcactgg

SEQ ID NO: 12762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagtacgaataccaatggagggttgacca

SEQ ID NO: 12763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagtctgttaatttgcctgtgtttggtcc

SEQ ID NO: 12764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagttgctgagatactagagccgtctcca

SEQ ID NO: 12765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacagtttgacgtatttggagtacttcgggt

SEQ ID NO: 12766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatagcgtctattggttgtcgcgcggcat

SEQ ID NO: 12767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatatctcgtgtttggcaggagtaccgca

SEQ ID NO: 12768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatcgattcggtatgtgaggtgggcctga

SEQ ID NO: 12769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatgcatgattaggtttaaactccccgcc

SEQ ID NO: 12770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatggtatgcacttttagtccccggatgg

SEQ ID NO: 12771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatgtcaggatttgtttgcacactcgagg

SEQ ID NO: 12772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacattaaggcgtacaggggggtaatgcagg

SEQ ID NO: 12773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacattcaaagcgctctcctccatgacgagc

SEQ ID NO: 12774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacattcgatcacgcctcatgggctgcttgc

SEQ ID NO: 12775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacattgcagggcaaatgtgctgtgggatct

SEQ ID NO: 12776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatttaccggttttatagatagactttgg

SEQ ID NO: 12777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatttactatgcacttaatctgcggccct

SEQ ID NO: 12778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacatttagcgctgcattgtaacgtaccgat

SEQ ID NO: 12779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaaatgatgttagacactgaaattccca

SEQ ID NO: 12780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaacaaggtttacatcagccccatgttg

SEQ ID NO: 12781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaaccgctacgtccagtggacgattttc

SEQ ID NO: 12782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaagcagtgtggaattgggccatcgggt

SEQ ID NO: 12783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaagcgcgcggtagtaccgcaccttagc

SEQ ID NO: 12784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaaggagcgcggggttggggacgcatta

SEQ ID NO: 12785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaatgccactcggttgtctgcgaccagg

SEQ ID NO: 12786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacaaattgcgtatgatattttcccacc

SEQ ID NO: 12787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacaagccgatgccgctggagtaggccg

SEQ ID NO: 12788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacacctgatggtctggcttttactagg

SEQ ID NO: 12789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacagcgtctaagagcggctaggcgacg

SEQ ID NO: 12790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacatctcaatgggtctcccgatgtact

SEQ ID NO: 12791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccacgacctggtgcatggaggagagattg

SEQ ID NO: 12792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccagaagccgtgagggcagagcaggtgag

SEQ ID NO: 12793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccagcccaggcccgggcaatggtcatggg

SEQ ID NO: 12794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccagcgtgccctgtcgaacgagtggggga

SEQ ID NO: 12795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccaggggtcgtgacgagatcactagtcat

SEQ ID NO: 12796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccatacttgacacccgcctgtagggatgg

SEQ ID NO: 12797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccatccccgagcgaacggaagaatggtcg

SEQ ID NO: 12798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccatgtgtgcgatgtggatctgacggacg

SEQ ID NO: 12799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccattcagtgttgggacgcacagttcgcg

SEQ ID NO: 12800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccaatgcggtttttgtacggtctgctcc

SEQ ID NO: 12801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccaccatttgcacaggcgtagcagtcgg

SEQ ID NO: 12802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccatagaggctagtccgacatccgtcaa

SEQ ID NO: 12803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccccacggcaagggtggttgggtaagcc

SEQ ID NO: 12804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccccgaccgctaattccgttctttgcctc

SEQ ID NO: 12805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccctattgcgaacggcgtcagtgtaacc

SEQ ID NO: 12806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccgagctggggatcttggtgattggtat

SEQ ID NO: 12807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccgagttaaggacacacccgagcaaata

SEQ ID NO: 12808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccgcccagacccatgcgacgccatatgc

SEQ ID NO: 12809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccgccgtcattcgtgtgttcaggtatcg

SEQ ID NO: 12810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccgggatcgagatcacagcccaccatgg

SEQ ID NO: 12811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccctacgcggtatgaccttagaggtagat

SEQ ID NO: 12812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccctattgcgtaaggatcttctcaatgca

SEQ ID NO: 12813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccctccttcgactgtgcttggcctataag

SEQ ID NO: 12814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacccttggatgatctgttaagggtttgcgg

SEQ ID NO: 12815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgacacattagctaggatctgcgttggg

SEQ ID NO: 12816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgacggcggcccttgatcagttgtggga

SEQ ID NO: 12817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgactcgacagacactgggggtacccgc

SEQ ID NO: 12818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgagtgacccggggttatctatttcggg

SEQ ID NO: 12819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcagagccgtgccccgtaattatcgcg

SEQ ID NO: 12820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcagcataatcgacgagatcctacgcc

SEQ ID NO: 12821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcaggatggcccccttctgtagttgtg

SEQ ID NO: 12822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcatgtatgtagaatcggaacgtggtt

SEQ ID NO: 12823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcgacatgcaccgagaatgatgtgctg

SEQ ID NO: 12824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcgcatacaccgtgtacgcagtctgtt

SEQ ID NO: 12825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcgcgagaaggactgtaggctacctgc

SEQ ID NO: 12826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcgtcaagagtctgggaggccgggtca

SEQ ID NO: 12827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcgttaatcaggattttcctgtgcacg

SEQ ID NO: 12828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgctctgcactcggttccactgattgac

SEQ ID NO: 12829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgcttttatgataccgcgacccgattgt

SEQ ID NO: 12830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccggaacgtacaaagtcgacatatacgag

SEQ ID NO: 12831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccggcacgaggaccagtatcagatacggt

SEQ ID NO: 12832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccggcgaaatatattcaagttaactttag

SEQ ID NO: 12833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccggcgtagtttacactgtgatgtagggg

SEQ ID NO: 12834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgggcgtaacgggatatatcctgtctga

SEQ ID NO: 12835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgggtcagcttgatgacgtgtgtagatc

SEQ ID NO: 12836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgtataccagggttgccaggtcggggct

SEQ ID NO: 12837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgtcgcccagtggggtaggacgctctac

SEQ ID NO: 12838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgtctttggtgacgttgcatggtgcaca

SEQ ID NO: 12839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgttacatgggtcctgcggattgcgact

SEQ ID NO: 12840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgttgggcatcccaatatgtcacgaatt

SEQ ID NO: 12841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgttgttacgcgctcttgtcttatctgt

SEQ ID NO: 12842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccgtttatgcgttaactatactagattag

SEQ ID NO: 12843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctaatcccccggggtcactcttttcggc

SEQ ID NO: 12844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctacccttgctgcatgtcagctgagtgc

SEQ ID NO: 12845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctagcttcattacatggagcactagcca

SEQ ID NO: 12846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctagtatcgacatcggtccccctttacc

SEQ ID NO: 12847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctcacagttttagcggggctttgaaccg

SEQ ID NO: 12848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctgcacttccaccgggtgagcagtgcgc

SEQ ID NO: 12849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctgcttcggtaaggtatcaagtttcgtt

SEQ ID NO: 12850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctggaatccaataaacggatgggccacg

SEQ ID NO: 12851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctggagaagttgctgtcattccctatct

SEQ ID NO: 12852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacctgtacttcccgtgatcgccgctcactg

SEQ ID NO: 12853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttactgagggtttcgggcgacaccagt

SEQ ID NO: 12854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttatgctaaagttccttctgatcttct

SEQ ID NO: 12855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttccccaccgtggtgtatcagaaacgt

SEQ ID NO: 12856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttcgggcattagaccatggaaatgacg

SEQ ID NO: 12857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttgcttggggattcatcggagtatgcg

SEQ ID NO: 12858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaccttgtacgctctttcggtaagtcgacgt

SEQ ID NO: 12859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaaaagtgtagagtgagcaataagggga

SEQ ID NO: 12860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaaacgtctgaagaggcctttttggttt

SEQ ID NO: 12861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaaatatcgctcgggaaacgtgatcgcg

SEQ ID NO: 12862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaacggttaacctttttagaacttataa

SEQ ID NO: 12863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaagaggcgtattcctaggcgatcggtg

SEQ ID NO: 12864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaagagtcgtcagtagccttatccattg

SEQ ID NO: 12865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaagcccgtcctaaattcattccgtgac

SEQ ID NO: 12866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaaggactccgacgctgtccgcattagc

SEQ ID NO: 12867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaagtgactgccggggtcctacgtgctg

SEQ ID NO: 12868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaatgggttgagttagcgcgcgctgggg

SEQ ID NO: 12869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaattgtgggatggtaggtcctgttgat

SEQ ID NO: 12870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaccaccagcgtgtagatgggctattag

SEQ ID NO: 12871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaccagttcagctaatcttacctactag

SEQ ID NO: 12872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgaccgggccgcgagcatgtgccggcaag

SEQ ID NO: 12873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgacgacggcattacggcagcagcacctc

SEQ ID NO: 12874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagaaccattttgcgctgggcactaacc

SEQ ID NO: 12875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagacgtggtgatatgaagagagtgcgt

SEQ ID NO: 12876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagagaactcggaatgtgactgcacgct

SEQ ID NO: 12877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagaggcccaactaggaacgcgcacgtg

SEQ ID NO: 12878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagagtccgtgttagccccctattcccc

SEQ ID NO: 12879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagcagattggaaataggctatacaggg

SEQ ID NO: 12880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgagttgcggtttgggcttgtgcccggtc

SEQ ID NO: 12881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgattatgttatttgcccagcactacggg

SEQ ID NO: 12882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcaaataccgccctgatcgtgtccaagt

SEQ ID NO: 12883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcaattgggcagcactgataattccgat

SEQ ID NO: 12884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcacatatggatcggtcgtcggcagtcc

SEQ ID NO: 12885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcagccgtctggagtcaatgcctttgta

SEQ ID NO: 12886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcagggggtaagcgcttatgggcccttt

SEQ ID NO: 12887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcagttgttgtgtgcgctcgcctgaacc

SEQ ID NO: 12888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcagtttactttactattctacgctgga

SEQ ID NO: 12889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcatatgtccgaccacggatcgacctat

SEQ ID NO: 12890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcccacactccggcaagtaccgcagtca

SEQ ID NO: 12891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgccggcattctttgcgcgacatgcttgg

SEQ ID NO: 12892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgccggtgtgctgggtggtggtaccgggt

SEQ ID NO: 12893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgacctcgtatgtgttgtagttcggcg

SEQ ID NO: 12894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgagaaaatccggcgtggtgacagcta

SEQ ID NO: 12895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgcgaaaagcgaagattgtaggttggt

SEQ ID NO: 12896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcggagacgaaagctgagccaggtggct

SEQ ID NO: 12897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgggaggttaatgaagcgccgggtcgg

SEQ ID NO: 12898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcggtttgtcgggcatctcttatccgcg

SEQ ID NO: 12899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgtcacgcgggcgttaggcacggtcgt

SEQ ID NO: 12900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgcgtgtcgaccagttgcgtcatctcaag

SEQ ID NO: 12901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgctcttgtgtaggcagctcccatggatt

SEQ ID NO: 12902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggaaacatctttcagtctggtgtgaaat

SEQ ID NO: 12903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggacatggtcactcgatagtggaggcgc

SEQ ID NO: 12904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggacggtccctttctagggtctgagaat

SEQ ID NO: 12905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggactccctcctgaatcgtgccttgtgg

SEQ ID NO: 12906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggatgaggcaatctaggcacgagccttg

SEQ ID NO: 12907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggattgtgtatatcgctgtccgagacgg

SEQ ID NO: 12908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcatgctcttcaaagtgttggtttatt

SEQ ID NO: 12909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggccaggtcgagtgtgcaacatatgcga

SEQ ID NO: 12910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcccccattacttgcgggtggtggtac

SEQ ID NO: 12911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcccggtgtcggactgatcttttggcc

SEQ ID NO: 12912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggccctaacaactgtacgacgtacggtg

SEQ ID NO: 12913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcctaatcagtgtgggtataatctcta

SEQ ID NO: 12914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcgcaacccaggtgccctctcaatttg

SEQ ID NO: 12915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggcggtacccggtatacctgctctagct

SEQ ID NO: 12916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggctgctgtactttcgccccgtcctagc

SEQ ID NO: 12917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggctggcggtaatcttctccatcttgcg

SEQ ID NO: 12918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggctggtctgggaagcacttcacagttc

SEQ ID NO: 12919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggaaacagcacatgaagctggggcgcg

SEQ ID NO: 12920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggagatttccgtgtacccatggtctct

SEQ ID NO: 12921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggccgagggttcaagaacatcgatgga

SEQ ID NO: 12922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggcgtccccaggatcgcgtaaccatgc

SEQ ID NO: 12923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggctttacgtctcgcctagggtagcac

SEQ ID NO: 12924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggggcgacgaggagggttaaagagcgcc

SEQ ID NO: 12925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggggactgtcggagggggccagtgtta

SEQ ID NO: 12926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggggcatctgtagcggttgctgcgctg

SEQ ID NO: 12927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgggggtgtgacgcggcggggtttcgctc

SEQ ID NO: 12928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggggtgcgctcgtcagactcatgtccac

SEQ ID NO: 12929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtatggagtttttgaatttgcaggccc

SEQ ID NO: 12930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtccagatctgtggaggtagcaagcgg

SEQ ID NO: 12931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtccggtgtcaggcgttaacgtcactt

SEQ ID NO: 12932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtcgcagaaagtgacgctcgtccggct

SEQ ID NO: 12933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtcgcggttttgttttgaagtctgctc

SEQ ID NO: 12934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtgagacctggtgggccacagccacgc

SEQ ID NO: 12935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacggtgcgagtcagcaggattggtggcccc

SEQ ID NO: 12936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtaagcgctctgcagtccgactggcccg

SEQ ID NO: 12937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtacaacaacacacgtccgaccgtactc

SEQ ID NO: 12938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtactgcgtctaccgtgagagattcgcg

SEQ ID NO: 12939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtaggcatggggttatcgtacttccctg

SEQ ID NO: 12940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtatacgtgcgatatacaagttccctgc

SEQ ID NO: 12941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtccaatatgcactgtcatggttgagcc

SEQ ID NO: 12942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtccagaggaagaacgtaccataccgat

SEQ ID NO: 12943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtcctttgcgtcccacaagtagccaact

SEQ ID NO: 12944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtcgatagtatagcacattacgcaccca

SEQ ID NO: 12945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtcggtacgcaagtaggatcatccgacc

SEQ ID NO: 12946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtctgagagtttccacacggtcaggggg

SEQ ID NO: 12947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtcttggcaacggccggaccgcatggcg

SEQ ID NO: 12948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgaaccctgcgatggtctgtctctttc

SEQ ID NO: 12949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgaatgcagcaatttgcacacgtgtcg

SEQ ID NO: 12950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgagacttgaggggaacctgcatagcg

SEQ ID NO: 12951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgcgagatttttagacaaccgtacggt

SEQ ID NO: 12952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtggagctagaacgttattactatcagg

SEQ ID NO: 12953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtggccggatttcctgcttttgttgtaa

SEQ ID NO: 12954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtggccggcatatttacatggattgtta

SEQ ID NO: 12955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgggcaacggagtaatcggctgcaagg

SEQ ID NO: 12956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgggcggcagaagcgggccgtgctggt

SEQ ID NO: 12957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtggtctcccgtaacggtggatttcgat

SEQ ID NO: 12958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgtagacgaacgacactcttggggtca

SEQ ID NO: 12959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgtatacatctcatgcccgagcttttt

SEQ ID NO: 12960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgtgtgcagtagaggcggccgaatggaag

SEQ ID NO: 12961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttaagggggggaaggcagccttgtcaa

SEQ ID NO: 12962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttacccgttcgacggactcggttgtgc

SEQ ID NO: 12963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttacttgggtatcgcagcgttcgcaat

SEQ ID NO: 12964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttatgtgttcttacccgggttgcgatg

SEQ ID NO: 12965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttgtggtttattattttctaattagac

SEQ ID NO: 12966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttgtgtccttttcacttaaatgcaaac

SEQ ID NO: 12967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttgttcgaaagacaatacgcacggact

SEQ ID NO: 12968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacgttttctgacccttcccttggtaagtta

SEQ ID NO: 12969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactaagccgttctccggagatcacagaggc

SEQ ID NO: 12970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactacccggaaccccatagtgcactatctt

SEQ ID NO: 12971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactacgcgtcttgaacaaccttgcatgacg

SEQ ID NO: 12972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactagcttgaagtgcgggttacatttggtg

SEQ ID NO: 12973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactagttttcctttgacgtcttatttgttg

SEQ ID NO: 12974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactatcagactgatacaggtaggttagtta

SEQ ID NO: 12975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactattatcgggcaaccttgatttgttcgg

SEQ ID NO: 12976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactattattcagacaggattgcaaggcctt

SEQ ID NO: 12977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcaaatccgtcacgactggcttcctctt

SEQ ID NO: 12978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcactgacggcgtgatataacgcgcccg

SEQ ID NO: 12979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcagccggttcactacgggaggacgcac

SEQ ID NO: 12980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcagtttcggctatcgggtccgtaccgc

SEQ ID NO: 12981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcatactaatgcttcactaggccaatgt

SEQ ID NO: 12982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcatcattacctaagtctataatgcgga

SEQ ID NO: 12983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcatgcatcttctggactcaaggtgtgg

SEQ ID NO: 12984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcatgtacgggcttttcccaacagtgtg

SEQ ID NO: 12985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcattcgcctgacaatggtgaataggct

SEQ ID NO: 12986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcattcgttggtcacatatgcttgcgcg

SEQ ID NO: 12987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactccacgcggctccccaggtatctgtact

SEQ ID NO: 12988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactccacggcgtcaggatgctatactgtca

SEQ ID NO: 12989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactccgactacgtcagtaaatgcaacgacg

SEQ ID NO: 12990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcctgtcttactgaacctcgcgactgtg

SEQ ID NO: 12991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcgagatggcaactggctgctagtggcg

SEQ ID NO: 12992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcgagtccaccgaccatatcatatctgt

SEQ ID NO: 12993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcgcatcccaagattcgcgacgacaggt

SEQ ID NO: 12994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcggccataggttaagcaaagcgacgcc

SEQ ID NO: 12995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcgggctgctttggcgtccaatgtggtc

SEQ ID NO: 12996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcggggttcaattgtcttcagttctcca

SEQ ID NO: 12997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactctgatcaccctttggagccgactgagg

SEQ ID NO: 12998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcttcggctgataaatcttacggtgagc

SEQ ID NO: 12999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactcttgtcacgtacgcgcctcgttactat

SEQ ID NO: 13000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgaacgacgcgggtcgcgccaaaggaca

SEQ ID NO: 13001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgaaggtctgtagaccgcgtcgcccctt

SEQ ID NO: 13002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgagcacagtccccgctcgtacctggtc

SEQ ID NO: 13003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgaggccggcttaacgtactcctgtttg

SEQ ID NO: 13004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgaggctcagtggggcatccttctgagt

SEQ ID NO: 13005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgataatcaacgccccaagggatacatg

SEQ ID NO: 13006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgatgctacttctagtctgcttgcctca

SEQ ID NO: 13007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgcagtgacaagcccccgtctaaaggct

SEQ ID NO: 13008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgccagggaaacaacgggcggcgggtcg

SEQ ID NO: 13009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgcgtttgactctttcgtgggcatgccc

SEQ ID NO: 13010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactggaaggtcaacgtggcagctcgagggc

SEQ ID NO: 13011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactggacgcaactggtcgctgctgtgaatt

SEQ ID NO: 13012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgggccaacccgggcaatctccttttcg

SEQ ID NO: 13013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgggcgctggaggtggtactctgactcg

SEQ ID NO: 13014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactggggccacccgaagataggctcgccgt

SEQ ID NO: 13015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactggtgtacggcgcaaccttggacggacc

SEQ ID NO: 13016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtcctttgtgactcgttcgtcctcggt

SEQ ID NO: 13017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtgatcgagcaggcaccatctcacgtc

SEQ ID NO: 13018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtgcgaaaatcgtgatcactctcggcg

SEQ ID NO: 13019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtgcttgttgtagtagttcgctcgggg

SEQ ID NO: 13020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtgtcgctccgatcatagtacgccagt

SEQ ID NO: 13021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtgtgggcgcggctaaaggatctgctt

SEQ ID NO: 13022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactgtttttgagcccacttaatgtagtttc

SEQ ID NO: 13023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttaagtccgtctgtggtgggcgagcgtt

SEQ ID NO: 13024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttacgaatacacccgagggccagaggcc

SEQ ID NO: 13025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttactgtttgcgtgtgtggtcaacacgg

SEQ ID NO: 13026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttagagagctcggaactgtcccttcacg

SEQ ID NO: 13027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttagcaccgttgatcatggtctttgccg

SEQ ID NO: 13028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttcacccgtttgtttcatcgtgagtatg

SEQ ID NO: 13029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttcacggcgtcaggcaggcgttcgagcg

SEQ ID NO: 13030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttcctcaacggtattacggtttgatgtt

SEQ ID NO: 13031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttcgcaaatagtcccccttggtgagcga

SEQ ID NO: 13032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttgcctggacatgcccttctatgctgag

SEQ ID NO: 13033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttgctaagtggcgttcggcgattgggcg

SEQ ID NO: 13034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttggatggtcgctgctgtacaatgctag

SEQ ID NO: 13035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttggtccgtagagtctcttttgcgcctc

SEQ ID NO: 13036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttggtcgtttatggtttgggtcctcgat

SEQ ID NO: 13037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttgtgagctggccgggaacgacacgagg

SEQ ID NO: 13038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactttctctaagcccctttttctttttaag

SEQ ID NO: 13039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caactttggcaggaccttacacagatgcttta

SEQ ID NO: 13040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttttcgcgacgggagggccgagtgtatg

SEQ ID NO: 13041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caacttttgacacataggaatccgtctttcgg

SEQ ID NO: 13042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaaaagacctggcttctgcatgtcccgtt

SEQ ID NO: 13043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaacatggactcgcgacatcacgaagtgg

SEQ ID NO: 13044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaaccacatggggtgcttgagcatcggcg

SEQ ID NO: 13045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaaccgctggagagaattggtctggtttt

SEQ ID NO: 13046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaacgaatttgcaaatgcagccggacaac

SEQ ID NO: 13047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaagagggagattaaggaaccgtggatcc

SEQ ID NO: 13048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaagcgtgccatgaacactttagtctccg

SEQ ID NO: 13049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaaggggatttcgttgttaccattttcgg

SEQ ID NO: 13050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaagggttacaggacgtttcgttcaggat

SEQ ID NO: 13051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaagtaatcaatgcactccaggatatcgt

SEQ ID NO: 13052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaatcggagcgggcacgagttgaaagtgg

SEQ ID NO: 13053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaatgtgcgcgcatcggcggaggggagat

SEQ ID NO: 13054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacaacacggtgccgtaggctatggactc

SEQ ID NO: 13055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacaatacgtcgtttgagtattcacacat

SEQ ID NO: 13056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacaatattagggcaccgttccccacttt

SEQ ID NO: 13057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacagaaaacgtgcggtcgaggttgcggt

SEQ ID NO: 13058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaccatgagacgggtttgcggtcaaatct

SEQ ID NO: 13059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacccatcttcagtgctcacgtcgcatcg

SEQ ID NO: 13060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaccgatccggcgtcccatgctgctgagg

SEQ ID NO: 13061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaccggtgtgtgctgaggtcggtgacatg

SEQ ID NO: 13062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacgagatggggcggataacgcaaaatca

SEQ ID NO: 13063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacgaggcggtttggacagtctttcttcg

SEQ ID NO: 13064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacgcattggtcatctcacggtctagggc

SEQ ID NO: 13065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacgtcacgccatagcctagccccgtgcg

SEQ ID NO: 13066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagactacttagtaacgttctaatacaaata

SEQ ID NO: 13067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagactgttctactctacgcggttatgcgtc

SEQ ID NO: 13068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagacttcacgaatggtatcagcggcttaca

SEQ ID NO: 13069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagaacggaccatggccacgagtgtaatt

SEQ ID NO: 13070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagcaaatgatctttaggtgtaggtcttt

SEQ ID NO: 13071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagccgaaagaggggcagtggcgcgggga

SEQ ID NO: 13072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagcgcagcaggggttggatcgaacgaac

SEQ ID NO: 13073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagcggagacggtcttgtgtacaaccggc

SEQ ID NO: 13074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagcggatgcttgacgggacaggcgcacg

SEQ ID NO: 13075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagctcacggtgatgcatgacccttcgat

SEQ ID NO: 13076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagctccaatgcgagcggactggcggccc

SEQ ID NO: 13077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaggagctgaagtcacgcgcagcgtccga

SEQ ID NO: 13078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaggcttccacatcgggatttactgtcac

SEQ ID NO: 13079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagggaccgcgcattgtgacctgggaatg

SEQ ID NO: 13080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagggtaggggggaaccctagcagtggct

SEQ ID NO: 13081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagaggtgaccttttcgacagaccggaccgt

SEQ ID NO: 13082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagtagggcttctgggttgctatcgggtt

SEQ ID NO: 13083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagtgacgatcggaaacgtacgggctctg

SEQ ID NO: 13084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagtgtggccgcccgccagtcttcggata

SEQ ID NO: 13085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagagttctcggaggccgtgtggagtcctag

SEQ ID NO: 13086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagataccagggaaggccattacatctgccg

SEQ ID NO: 13087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagataccgattctgtcactgtcagacggcc

SEQ ID NO: 13088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatacgggtcacgtgggaagtgggagttg

SEQ ID NO: 13089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatagcaccgattaccacggaccaagccc

SEQ ID NO: 13090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatatccgaccctcgaactgtggctgcgc

SEQ ID NO: 13091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatccaaaggcgttagcattggtgcagta

SEQ ID NO: 13092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatccagtgcaaaaagtagtgattggttg

SEQ ID NO: 13093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatcgactcctttactacatgtcgggcct

SEQ ID NO: 13094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatcgatgacggtggacgtaggtcgtctt

SEQ ID NO: 13095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatctctttcgtggatccggtttgctgac

SEQ ID NO: 13096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatgacatcccccgtttgtggccgacggc

SEQ ID NO: 13097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatgacgtgtcaaggggcgatttgctcgc

SEQ ID NO: 13098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagatggctggtgaaggtggttttgccgcta

SEQ ID NO: 13099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagattctaccccgcgctgactcgttgttac

SEQ ID NO: 13100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagattgcctggtccgattccgcagccagtg

SEQ ID NO: 13101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagattttaggaacagcatgccatactgacg

SEQ ID NO: 13102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcaaataactaccggcctggaggagtgcg

SEQ ID NO: 13103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcaaggattgatctcaagtatgcgtgtgc

SEQ ID NO: 13104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcaaggccgcatttagccgtgctcagtga

SEQ ID NO: 13105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcacacgctagtaagcaaatcttgtgggg

SEQ ID NO: 13106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcacagttcggcagcccgctgagcgactc

SEQ ID NO: 13107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcaccatacctgttgtcatgatttgcggg

SEQ ID NO: 13108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcacctgcggaaatcagaaagatttcaat

SEQ ID NO: 13109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcactccgcgtcgtactcctcaaaggagc

SEQ ID NO: 13110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcactgccaccacgcgcctgatttacggg

SEQ ID NO: 13111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcactggtttcgtcgctgttttcggctcg

SEQ ID NO: 13112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagacgctgcgcagatatcgtaattgag

SEQ ID NO: 13113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagatatctctgtgacttttcgactttt

SEQ ID NO: 13114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagccacctcggaaagtagcgcatctag

SEQ ID NO: 13115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagggactgttactgtagctcgggctgt

SEQ ID NO: 13116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagggtttttgcgtttcacgggaattcg

SEQ ID NO: 13117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagtcgatagctcttctagtggaggtac

SEQ ID NO: 13118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcagtttatagtgggttgtcgatcgtccg

SEQ ID NO: 13119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcataagtacagggcagagtccgcagaga

SEQ ID NO: 13120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcatagaagcgcaatcgcgtctgcgtttg

SEQ ID NO: 13121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcatctatgtgctgttagttatagggcgg

SEQ ID NO: 13122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcatctgatagtctgtttatcccgcgccg

SEQ ID NO: 13123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcatgaaggtcctcgcagcgagccgtgca

SEQ ID NO: 13124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcattcgttaggtttttggatgttggact

SEQ ID NO: 13125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccacgacaacgacggccactacactagt

SEQ ID NO: 13126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccacgcacggaacgaaaaacggcttatg

SEQ ID NO: 13127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccactcctggcattacgggcagcctcgt

SEQ ID NO: 13128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccagtttcatattcccggagactccccc

SEQ ID NO: 13129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccatctgcagacttcttggcgtggaggg

SEQ ID NO: 13130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccctcgaactgttagcctccgggggccg

SEQ ID NO: 13131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccctcggagcactccactcaatgccgcc

SEQ ID NO: 13132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccctgcttataggatgtaattcaaccct

SEQ ID NO: 13133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccctttagtcgcactcacagtcccgctg

SEQ ID NO: 13134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccgaggagccttgcgcggtgcgttttcg

SEQ ID NO: 13135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccgctgtatggatcgtacgtcatgaggc

SEQ ID NO: 13136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccggaaggggcggggtggagtcgtggcg

SEQ ID NO: 13137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccggagggtggtgttgtatactcgcgta

SEQ ID NO: 13138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccgtagtcgcgagggctcgcactgggac

SEQ ID NO: 13139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccgttgttccgggccggccaaaagctac

SEQ ID NO: 13140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagccgtttcgctgaatttgctccgtccaga

SEQ ID NO: 13141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcctatcaggctcaactgttgtcaaactc

SEQ ID NO: 13142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcctcgttgatattccattcctgggtgtg

SEQ ID NO: 13143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgaagggtgcaattgatagggtgcgctc

SEQ ID NO: 13144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgactagttccaggctcgaatgctcgaa

SEQ ID NO: 13145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgagggagttcgccgggcgcaactggcc

SEQ ID NO: 13146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgagtggccggaagaggagttgggcgtg

SEQ ID NO: 13147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgccaggggtttggctgcagcgagggac

SEQ ID NO: 13148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgccgggcagggaacttaagatcgctag

SEQ ID NO: 13149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgccgggttcaatgcctctcgtaacttt

SEQ ID NO: 13150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcctacccacctgtccggtataatccc

SEQ ID NO: 13151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcgacaaatgctggctctttggacgga

SEQ ID NO: 13152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcgatcagtaggtcggcataaggaccg

SEQ ID NO: 13153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcggacgttcaccgaagtgggtttttc

SEQ ID NO: 13154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcgggccaggccactttcagattaccc

SEQ ID NO: 13155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcgtgtgcccaaattggagggccggtc

SEQ ID NO: 13156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgctagaaccactctcgctcactcagcc

SEQ ID NO: 13157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgcttggtctcgtaaagcatagaactgt

SEQ ID NO: 13158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggatcttttccgtatgctgaggtatct

SEQ ID NO: 13159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggcatgcgtcacccggagaatgcgtac

SEQ ID NO: 13160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgggattctgtgggggcctgttgcgcgc

SEQ ID NO: 13161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggggaaatccatcttggtattttgatt

SEQ ID NO: 13162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggggccgcgtgtgatgtcttgaccacg

SEQ ID NO: 13163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgggttgcgatacgagcttccggcctgt

SEQ ID NO: 13164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggtacgttttatactgaggggatttac

SEQ ID NO: 13165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcggttgggggatgagccagatgcgaggg

SEQ ID NO: 13166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgtccagttcctttagctccgggagtag

SEQ ID NO: 13167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgtcgggaggccaatctatccggctgca

SEQ ID NO: 13168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgtgacatgggcatcatacaacgtagtt

SEQ ID NO: 13169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcgttcccttaacagtcgacactcacggt

SEQ ID NO: 13170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctaggcagctgcgacacgtgattgccac

SEQ ID NO: 13171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctatatcgtttcagggaggtggtacatc

SEQ ID NO: 13172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctcatgggtttccccaggttgtaacgag

SEQ ID NO: 13173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctcatgttcatggagttctggatcggta

SEQ ID NO: 13174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctcggcaaaacccctgttggcatccccg

SEQ ID NO: 13175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgaatttaatttgatcagtaggtgctg

SEQ ID NO: 13176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgaggttgacgctagccgcgggaatgc

SEQ ID NO: 13177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgagtaaatctgtggtggcttccgggt

SEQ ID NO: 13178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgagtgtgatagtaacgtagaaacccg

SEQ ID NO: 13179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgcggggcggatccagtaagaggtcat

SEQ ID NO: 13180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgggctgtatatttacatgaagtggaa

SEQ ID NO: 13181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgtcagggattttggtacggatatggg

SEQ ID NO: 13182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctgtgcttaaactttcctttctcgaagc

SEQ ID NO: 13183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagctttgtaggggtatcacgatgagctccg

SEQ ID NO: 13184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagcttttgctccggttcttctatattgcgt

SEQ ID NO: 13185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaaacttcggggaccaggccacgagcgg

SEQ ID NO: 13186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaaggcacgcacaaaacgccggtccgtg

SEQ ID NO: 13187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaagtggttacggcggttttattctttc

SEQ ID NO: 13188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaataacagtttcggatcgtccgatcaa

SEQ ID NO: 13189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaattcctaccacttagagaccatcgga

SEQ ID NO: 13190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaattgctcgatcgtaatggtgcgtccc

SEQ ID NO: 13191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaccaaaacttttgttacattatcgttt

SEQ ID NO: 13192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaccaacatgtcggatgtagcaggacgc

SEQ ID NO: 13193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaccgccaacttatccgcccgttgatgg

SEQ ID NO: 13194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggacctacgcgcattcagccctgtcgtcc

SEQ ID NO: 13195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggacgcaacgccagcatctttattccagg

SEQ ID NO: 13196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggagatccgttgttgcgcagactggccct

SEQ ID NO: 13197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggagatgtccaatacgacgctcagcggtg

SEQ ID NO: 13198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggagcccaatgctcgagtgttccgtggct

SEQ ID NO: 13199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggagcgctgcggtcacggggttcattaat

SEQ ID NO: 13200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggagctatgatttagtggttatttaggtt

SEQ ID NO: 13201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggaggagggtgcgcttggatgagcttcct

SEQ ID NO: 13202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggatcaatcacaaccgatgcccgtggatg

SEQ ID NO: 13203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggatgctcgttatacgcaccgtttctcgc

SEQ ID NO: 13204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggatggaactccgaagtaacactgtttgg

SEQ ID NO: 13205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggattgtgtgaacccgcctcgatttatat

SEQ ID NO: 13206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcaacgcagtcccccatttaattccgtg

SEQ ID NO: 13207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcacggatcgattgtatgcaacagtgtt

SEQ ID NO: 13208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcacggcacctcttgcgtggcactttaa

SEQ ID NO: 13209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcacgtcaatagagcaataccctattac

SEQ ID NO: 13210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcaggcgtcggccaatgagattagggaa

SEQ ID NO: 13211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcagggggagccctaagtcactacccca

SEQ ID NO: 13212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcagtgctctctcggtcaaatcgggccg

SEQ ID NO: 13213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcatgccgactcctctggtttgttgtgg

SEQ ID NO: 13214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcatgcggctatgtggcggccttcactc

SEQ ID NO: 13215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggccctctgcaagaaatgtacatacggtt

SEQ ID NO: 13216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcctacaaactacactgtcatgggctcg

SEQ ID NO: 13217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcgattgtttcgtgcaatgtaacgactg

SEQ ID NO: 13218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcgcagcccacctaggtcggtgtagcgt

SEQ ID NO: 13219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcggacacgtcgactgggcaatgtccga

SEQ ID NO: 13220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcggacgtgtcaagacggtggcacgacg

SEQ ID NO: 13221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcggaggagttctccactcacaagtcat

SEQ ID NO: 13222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcggtccttagagtctagcggatgtgag

SEQ ID NO: 13223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcgtccgtttgtcggcatcgtttggctg

SEQ ID NO: 13224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggctcagggctgtgctcgaggaaagccgc

SEQ ID NO: 13225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggctccggaacgattccaagctcagcgta

SEQ ID NO: 13226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggctctcgggtcgcatcaccgcggcagcg

SEQ ID NO: 13227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcttaggatgtcacctgggtgtgtaccg

SEQ ID NO: 13228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcttgcgagtcgaaagggtctgtgggcc

SEQ ID NO: 13229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggcttgtaacgagtgctccccccagtata

SEQ ID NO: 13230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggaaaccgcccagggtatggtaacgcgg

SEQ ID NO: 13231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggaaactatgaggactttcagaagtgaa

SEQ ID NO: 13232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggacagactaagcgcttaccagactgct

SEQ ID NO: 13233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggacagctagatgggactcatggtggac

SEQ ID NO: 13234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggaccagggctgaacgagcgcggcggcg

SEQ ID NO: 13235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggacggagcgctcattagggtagttcca

SEQ ID NO: 13236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggagcacgtgttgcagttctggcctacg

SEQ ID NO: 13237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggagtcgatcattccgtgtgattgttcg

SEQ ID NO: 13238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggatagtgatgtaccacgcgcgacgaac

SEQ ID NO: 13239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggatggtcagggtcgtggctagctggga

SEQ ID NO: 13240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggcaccccttggattgcttgtcgttcgt

SEQ ID NO: 13241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggcacgatcttcctgtgggccacgcttt

SEQ ID NO: 13242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggcacgcagctaactcacgggcgtctta

SEQ ID NO: 13243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggccagcctaggggtgcatgacaggatg

SEQ ID NO: 13244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggctgctgtccatggttggagccaccta

SEQ ID NO: 13245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggaaagggggtaaatcggggttgggcg

SEQ ID NO: 13246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggatcaaccaatggggctccggtttga

SEQ ID NO: 13247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggatccgagcacttaaacggccttgag

SEQ ID NO: 13248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggcacgccaagtgagcttgtctttggg

SEQ ID NO: 13249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggcgcgggtagggtaccgggcagcaat

SEQ ID NO: 13250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggcttctcgtataacgatcgatcggag

SEQ ID NO: 13251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggggctcgcgacacgttgcatagggcgg

SEQ ID NO: 13252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggggcttttgacgtgggtcgacctcgtt

SEQ ID NO: 13253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggggatacgggtttcagctgatgaatt

SEQ ID NO: 13254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggggtgaaaggtgttgcagaataacggt

SEQ ID NO: 13255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggtcctgtgcccaattcttttggtcgt

SEQ ID NO: 13256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggggtcggagtcgcgtattcttaatatta

SEQ ID NO: 13257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtaggggacgcgggcatgcacaggacc

SEQ ID NO: 13258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtatatgcatggagacgcttcttggtg

SEQ ID NO: 13259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtattgggcaatcggtgtgagttcccc

SEQ ID NO: 13260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtcggtccgggaaccccctgaccagtg

SEQ ID NO: 13261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtctgcggtttggcagcgtacaagggc

SEQ ID NO: 13262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggtgttccgtttgattgcaacggcgtcg

SEQ ID NO: 13263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggttcggcggctaaatacgactgagctt

SEQ ID NO: 13264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggttctgctacgtctgttccctcaccta

SEQ ID NO: 13265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagggttggtggatattcgcgactcacggta

SEQ ID NO: 13266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtaacgcatggtgatcttccagtcgccg

SEQ ID NO: 13267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtacagtcaatgaggatcgcgatatgtc

SEQ ID NO: 13268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtagaacgcgggcaattccggcagatct

SEQ ID NO: 13269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtattaaggttcgccttcggctcgcctc

SEQ ID NO: 13270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtcaagccaactttctagtaaaaatggc

SEQ ID NO: 13271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtcctttgagtcacgcgtgtgaggtggt

SEQ ID NO: 13272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtcgtcgacattatagccgtgtatcccg

SEQ ID NO: 13273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtctctcacggatctttggatttgcttg

SEQ ID NO: 13274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtgtataccgcatgaaaccggactagtc

SEQ ID NO: 13275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttagcgccaggtgcacaatgccgtttc

SEQ ID NO: 13276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttcactctcatttatccggcgtttgtt

SEQ ID NO: 13277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttcctcgtgtccagccttggtcctttg

SEQ ID NO: 13278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttcctgtaaacagaattagtaacttgc

SEQ ID NO: 13279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttctcactgctacctattcataggcga

SEQ ID NO: 13280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggttgggcggcactcctaagcgcctagtc

SEQ ID NO: 13281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtttgactgcgtaactaggtggtgccgc

SEQ ID NO: 13282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caaggtttgcacattggccacttcagtgcgtt

SEQ ID NO: 13283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtaaacggttaatatctgtccaatccagt

SEQ ID NO: 13284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtaattaaagatagcattgaccctggaaa

SEQ ID NO: 13285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtaattctggtctcatggttatggtactc

SEQ ID NO: 13286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtaattttactaaagtcccgtttttattt

SEQ ID NO: 13287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtaccaccgaaggttctacgttatggtgg

SEQ ID NO: 13288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtacggcgcgtacggcatttattcctctc

SEQ ID NO: 13289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtactggcgggagggcactctttcgatta

SEQ ID NO: 13290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtagggcgtatcctcaggggattccgcga

SEQ ID NO: 13291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtagtcaactcggatacgcgtctctttag

SEQ ID NO: 13292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtagtgccgttagagcatcagatgactgg

SEQ ID NO: 13293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcaagtacagtacggacacagcgtacgc

SEQ ID NO: 13294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcaggactcacccgggatagtctgcggg

SEQ ID NO: 13295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcagtcctctcatcgtatctttagtaat

SEQ ID NO: 13296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtccacagagaggttttccctgctggcgg

SEQ ID NO: 13297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtccattacgttccgttgagtgttggagg

SEQ ID NO: 13298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtccccctgagttgttgtgaacccgccct

SEQ ID NO: 13299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcccgcagtgacattgaagagggtgttt

SEQ ID NO: 13300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcccggtgttttggtgtaatgctgagga

SEQ ID NO: 13301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtccgagcgagcacgggagatcatggacc

SEQ ID NO: 13302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtccgccacgttttaacacactcacaatg

SEQ ID NO: 13303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcctaggctagagtactgctacttcgtg

SEQ ID NO: 13304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcctcgacactgatcggacacgcgtcta

SEQ ID NO: 13305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcgataatactcgttcgcataatggggt

SEQ ID NO: 13306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcgcaagtggcagcagaagcaagggtcg

SEQ ID NO: 13307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcgccacaccgtgtgcctaagagggaac

SEQ ID NO: 13308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcggcctgattactcgtgcatatccacc

SEQ ID NO: 13309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcggctttttttcggagaacgttttcgc

SEQ ID NO: 13310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcggggctacggcagttgagcgtgacgg

SEQ ID NO: 13311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcgttcccctgcaccgtgatttatattt

SEQ ID NO: 13312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcgttcgcatcgaatgttaccgtgggca

SEQ ID NO: 13313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtctcttgcgtcgaaatggtagtacgcga

SEQ ID NO: 13314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtctgtagctcaccagtcgcttattgttc

SEQ ID NO: 13315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtcttctattgttatccaccaccccgaag

SEQ ID NO: 13316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgaaaccgagtacctccacgatgagaat

SEQ ID NO: 13317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgagggagggcgacgggttattcatatc

SEQ ID NO: 13318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgcaaaggttcgtgatcttgggctgatc

SEQ ID NO: 13319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgcaagtcttttaagtgcggggcaccgt

SEQ ID NO: 13320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgcgagccgaaatgtgagcatgatagtc

SEQ ID NO: 13321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgcgtcacgaatccatggtctaagcata

SEQ ID NO: 13322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgctataccgggtggacgcgtccctgtt

SEQ ID NO: 13323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggatcccctcaggaacgtctttgccgc

SEQ ID NO: 13324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggatcggtcttatggggtagataaggc

SEQ ID NO: 13325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggcaagaaggtaacgtccggtccgcgt

SEQ ID NO: 13326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggcctagcagcgtctgagatgagagtg

SEQ ID NO: 13327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggctcctttatggacgtcagattctcc

SEQ ID NO: 13328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggctcgtgactattatggacaaccacc

SEQ ID NO: 13329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgggagtgacattcgttgcgcacccttg

SEQ ID NO: 13330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgggtcaaagtctgggcttccttacaga

SEQ ID NO: 13331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggttcgtgttgaacacaggttgcgttt

SEQ ID NO: 13332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtggtttcagctcttgagaaactcgtgta

SEQ ID NO: 13333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgtacacgaccacgcgaaggtcttctac

SEQ ID NO: 13334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgtagggtagtttctcgcgctgttctgg

SEQ ID NO: 13335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgtcacgactgggtggacatgattgttt

SEQ ID NO: 13336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgtcggtctgccctctacgtagtctcgt

SEQ ID NO: 13337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgtgaagataagcccgggtagcatgggg

SEQ ID NO: 13338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgttacgatgtgtttgtgtgcaagttag

SEQ ID NO: 13339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtgttcgataccgttaacttggcattact

SEQ ID NO: 13340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttaagggtgacgagaccgacgcttgttc

SEQ ID NO: 13341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttagcttggcgaaaagtgttagacttcg

SEQ ID NO: 13342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttcaaggtttcgcatccttgtggtctct

SEQ ID NO: 13343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttcaccggtgctcacggactcacgacaa

SEQ ID NO: 13344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttccgcattcctccttagccaacctcat

SEQ ID NO: 13345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttcggatgcggagatcgggcccaaacgg

SEQ ID NO: 13346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttctgatgtgatatgtataggcattggg

SEQ ID NO: 13347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttgaaacatcatggctcaagctgtcagt

SEQ ID NO: 13348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttgcagtcccctgttgttggcccttgtg

SEQ ID NO: 13349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttgcggcaggcgttatccacactccgtc

SEQ ID NO: 13350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttgctcgaataattcctctctgccatgg

SEQ ID NO: 13351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtttcagttaccgattggcgggacagtta

SEQ ID NO: 13352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagtttgtatccctccccgtcactccccttg

SEQ ID NO: 13353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caagttttcaattatgttcgattcaagctttt

SEQ ID NO: 13354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataaacagggcggaaaagacgagccccacg

SEQ ID NO: 13355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataaatttccatgttaggtcccgatagcgc

SEQ ID NO: 13356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataacgtaagattctttgttcgaggccgtt

SEQ ID NO: 13357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataaggcctgtagtcgtatcgttgactgca

SEQ ID NO: 13358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataaggtatatcttatgaggtaaactttca

SEQ ID NO: 13359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataagtcatctgttccgatccaaggtgggt

SEQ ID NO: 13360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataatacttaggtgcatcactctcattagg

SEQ ID NO: 13361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataatagtcacgtcctgggggcgactactc

SEQ ID NO: 13362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataatgggttgcagcgccggtcatgcgatt

SEQ ID NO: 13363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataattcctagtcgcggattggcatttgtg

SEQ ID NO: 13364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacagtggtagttgacacatacttgaggt

SEQ ID NO: 13365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataccgcccccgtagctcacgcacctgctc

SEQ ID NO: 13366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataccttgagtgatagtattagggttctgt

SEQ ID NO: 13367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacgagaccgaaatccgacttaaatcgca

SEQ ID NO: 13368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacgcagcactcggtctacaactatccgg

SEQ ID NO: 13369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacgctagctaacggagagcggtcgggcg

SEQ ID NO: 13370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacggggtactcgatatttgataatcagg

SEQ ID NO: 13371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatactaatcggaaccaagtaaacgcggcta

SEQ ID NO: 13372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatactgccatctgagggatcgcacactttt

SEQ ID NO: 13373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatactgcttttatgcgtgcgcatcgtaaca

SEQ ID NO: 13374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatactggtagagtaaagatcagaagtcaca

SEQ ID NO: 13375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacttctgcagggcccccgccatcatctg

SEQ ID NO: 13376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatacttttattttttcgccggtttttcatg

SEQ ID NO: 13377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagaatatcgattggctagtaggcctcgc

SEQ ID NO: 13378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagcacctgctgatcaaagtcgggctctg

SEQ ID NO: 13379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagctcttagcttagcagtgcccatggtt

SEQ ID NO: 13380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataggacgggtcgcaagcacctgcgttttg

SEQ ID NO: 13381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataggagaagagagttgtccggacgttcaa

SEQ ID NO: 13382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataggcctagtcctgacttcggtattcgtg

SEQ ID NO: 13383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagggccttagaattcccgcggtccactc

SEQ ID NO: 13384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataggtactgtgggtctgtatcgggtggtc

SEQ ID NO: 13385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caataggtgggtgctctatgcatgtaacttca

SEQ ID NO: 13386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagtagcagcggggccacgtcgtttattg

SEQ ID NO: 13387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagtcgacctacgatggaaatggcgcgga

SEQ ID NO: 13388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagtgtcataacgaaccgtcctttggcct

SEQ ID NO: 13389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatagttgtgcctggacggattcgcgtgcta

SEQ ID NO: 13390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatacatgcccgaagccgtggcatatcca

SEQ ID NO: 13391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatacgatatttagcctttcttgggacct

SEQ ID NO: 13392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatacttgcttgggcgacctgtggtgatc

SEQ ID NO: 13393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatatgattcacgattttagccaagaact

SEQ ID NO: 13394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatcgtttagcgcactaaatgaggtttgg

SEQ ID NO: 13395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatgactcaatcagagctctgtcttttgt

SEQ ID NO: 13396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatggaggccgttttccgatcgtgcttgt

SEQ ID NO: 13397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatgtgcgcctccactgccaacaccgggt

SEQ ID NO: 13398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatatgttggacccggcaagtatattgatac

SEQ ID NO: 13399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatattccgctcacttctgtgctgagcgaac

SEQ ID NO: 13400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatattcgtctactacgcagcccagcacaca

SEQ ID NO: 13401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaaaggctatatacgcggacctggtttt

SEQ ID NO: 13402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaacaaggccttacgccattgctcggga

SEQ ID NO: 13403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaaccggaggtatgcgtcacttccggac

SEQ ID NO: 13404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaactgcgtaggagaatttgtggcacct

SEQ ID NO: 13405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaactttctatactggggttttagctaa

SEQ ID NO: 13406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaagatcccggaggaggccaattgagtg

SEQ ID NO: 13407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaatacgtcctcggtccctgtttatggg

SEQ ID NO: 13408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaatcaacaaggaaatattgtagtaaag

SEQ ID NO: 13409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacaggaggaattgcatcctggtactta

SEQ ID NO: 13410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacatcaacagttggtgaccgatgcatg

SEQ ID NO: 13411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacctcacttgctgcatggactctgcac

SEQ ID NO: 13412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacgccggatcttactgaacctagggac

SEQ ID NO: 13413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacgggcgtgacggaggtacgcttgcca

SEQ ID NO: 13414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacgttcaacatatctaggcggcgtacg

SEQ ID NO: 13415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcacttttgtggcggacggttaacttaga

SEQ ID NO: 13416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcagaatccgcttggatctactatccggg

SEQ ID NO: 13417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcagcatccagtggggcctttacccaatt

SEQ ID NO: 13418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaggaggcagcatcgtcccgccttagcc

SEQ ID NO: 13419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaggagggagcgcagcagcctggagccc

SEQ ID NO: 13420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcaggttggccggcgctaaggcgtggggt

SEQ ID NO: 13421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcagttgtacgaggccgcgtgctggccca

SEQ ID NO: 13422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcatcgctgagtatgacggttcagtgctg

SEQ ID NO: 13423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccaacgatttctagggacgcgtggtttt

SEQ ID NO: 13424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccaagcgaaactgttgtgagctcgcccc

SEQ ID NO: 13425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccaaggcccaccctttcgtgttatccta

SEQ ID NO: 13426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccacaccatccccaatcggttaaaacgg

SEQ ID NO: 13427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccaccttacccagttctcgcaatccccg

SEQ ID NO: 13428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccatggtgccatttttgctagttgaggg

SEQ ID NO: 13429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcccggtaacttatcctacctgtgggttt

SEQ ID NO: 13430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcccgtcgtggggctgatggaatggtttt

SEQ ID NO: 13431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcccgttgtaataacttcgcggggtcata

SEQ ID NO: 13432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccctcatctccaatcgtggtgtcgtgac

SEQ ID NO: 13433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgcgaatctagttaccgccgcaagttg

SEQ ID NO: 13434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgcggaatatgcacaccgctcttagcc

SEQ ID NO: 13435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgcttaactaagagggggaggaccttc

SEQ ID NO: 13436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccggcttgggtggtttgagcagggcgct

SEQ ID NO: 13437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgggggtctccgtaatacggtgatggt

SEQ ID NO: 13438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgggtggcccctaccttatcgggcttc

SEQ ID NO: 13439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccgtacatcggtcggagtgggttgggat

SEQ ID NO: 13440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcctagcacctcgctggtggatcgcattg

SEQ ID NO: 13441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatccttgtatgttgggtgagactcgagtac

SEQ ID NO: 13442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgaagatgacgctgtctactccgaaggg

SEQ ID NO: 13443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgaccgtaagcacttgtgtaatatggtg

SEQ ID NO: 13444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgacgttccgcggttaccctatgttcct

SEQ ID NO: 13445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgaggtgcgttcctaccttacacgccgc

SEQ ID NO: 13446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgataggtgtacaattgcgccattttgc

SEQ ID NO: 13447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgatatgcgttctcctagttcgttctga

SEQ ID NO: 13448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgatcgttattatggaactctttgtccg

SEQ ID NO: 13449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgcacaatggacagcaccgtatgtctgc

SEQ ID NO: 13450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgcggatgcagagttttactgtgtgata

SEQ ID NO: 13451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgcggtcgatgtctagagggctagctgt

SEQ ID NO: 13452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgctcgaacgcttagatgtattatcgac

SEQ ID NO: 13453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgctggccgcacaatcgcccttacgcca

SEQ ID NO: 13454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcggaacgtttaaagtgagtaacccacgg

SEQ ID NO: 13455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcggatttccacgtacaatcatctcgtat

SEQ ID NO: 13456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcggcatggacgcaatgcattggagttac

SEQ ID NO: 13457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcggctagcgtgcgatcacccgcgcttcg

SEQ ID NO: 13458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgggcaaccaataatcagcggggaattg

SEQ ID NO: 13459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcggggtgcagggattgaaaccttcccgg

SEQ ID NO: 13460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgggtcttcaaccgcattctgtggaccg

SEQ ID NO: 13461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgtccgccagaacgccatgttgtaagcc

SEQ ID NO: 13462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgtcgggcggcggagtactcattaatct

SEQ ID NO: 13463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcgtgatcttatggatctgacttagctca

SEQ ID NO: 13464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctacatgcggtgcgctcacatggtttat

SEQ ID NO: 13465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctactgcgtcccgtttccgtcttgtata

SEQ ID NO: 13466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctctggtctccgattgctcaggaaagaa

SEQ ID NO: 13467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctcttgttgccacgcttcgtgttggtgg

SEQ ID NO: 13468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctgacgtgtgtctcggtggatccgctta

SEQ ID NO: 13469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctgatggcccctttatttctgttcgctc

SEQ ID NO: 13470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctgcgtgaatgacatctctcttaacgcg

SEQ ID NO: 13471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatctgtagtgttccaagtgaggtataatgt

SEQ ID NO: 13472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcttaagtctttttgcagcggagccattt

SEQ ID NO: 13473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcttagactgcgccacgacttggccctgg

SEQ ID NO: 13474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatcttctagtcaacactattttcgcggaat

SEQ ID NO: 13475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaacaggtataaaagtttgcgcacaaag

SEQ ID NO: 13476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaactgcgaattactccaggatcagaag

SEQ ID NO: 13477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaagtcggataagcatacccagtagcgg

SEQ ID NO: 13478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaatgaaacgaagtgttcgccctttgag

SEQ ID NO: 13479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacaagttgtggcagttctgttttggcc

SEQ ID NO: 13480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacacattggccggccgagcagactggg

SEQ ID NO: 13481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacacgtggtgttactgtgtgcacgacg

SEQ ID NO: 13482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacactgatgaacctggatggtgtgggc

SEQ ID NO: 13483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaccaggatcatgtgtcacccaagagta

SEQ ID NO: 13484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacgctcgctgatcgtatgaccaacgtt

SEQ ID NO: 13485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacggcttagtctacgtttcgttgggtc

SEQ ID NO: 13486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgactctaacctatatgggttagatacta

SEQ ID NO: 13487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacttactagccgagtgcagagcttttc

SEQ ID NO: 13488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgacttccatggtcatgttacagctgccg

SEQ ID NO: 13489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgagcccagtaagcgacgagccgcatgct

SEQ ID NO: 13490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgaggtaggtggctttttggtatagctgc

SEQ ID NO: 13491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgatgtgaactattcggttgacggcaagt

SEQ ID NO: 13492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgattctgctacaagcgtttatcttgtgt

SEQ ID NO: 13493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcacagtccaccggcttcatctcgcttc

SEQ ID NO: 13494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcaccgtctaagtacgactggatacacc

SEQ ID NO: 13495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcaggttgggtggcggttcttcgcgatg

SEQ ID NO: 13496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcattgcagcatttgcatgtcgccattt

SEQ ID NO: 13497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgccaagaacccgctagccctgcataaat

SEQ ID NO: 13498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgccgtcggccctccgggtagtccgcagc

SEQ ID NO: 13499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcctgggatgggactggcaccgaatcaa

SEQ ID NO: 13500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgacctatgggttgtcttcgggtattg

SEQ ID NO: 13501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgattgtgttctggtgttgtaggtatg

SEQ ID NO: 13502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgcacggttaacatgtactgctgtgct

SEQ ID NO: 13503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgccggacaatcagtttattcgtacac

SEQ ID NO: 13504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgcgaagaatgctagcaatatgcgggt

SEQ ID NO: 13505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcggaaggtcgtcctagcacttcgatgc

SEQ ID NO: 13506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcggacaacatcctcttcagctggcggt

SEQ ID NO: 13507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcggcatcacataacgagtctcttcggt

SEQ ID NO: 13508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcggggccacagcgcgagatttctgtgg

SEQ ID NO: 13509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcgggggatcggcgctgatggcctgtga

SEQ ID NO: 13510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgcggtggcctggcactttgagacagagg

SEQ ID NO: 13511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgctccattagtgggtgcaagtcgtgcat

SEQ ID NO: 13512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgctgcgtgcgtaaatccatggagcggct

SEQ ID NO: 13513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggacgttggggggggtcgtcacggcaag

SEQ ID NO: 13514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggactcgcttagcctcacacgatcaccc

SEQ ID NO: 13515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggagaacggcgaggtgtcagctgtcgca

SEQ ID NO: 13516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggaggagggtcaaagaggtccgtccgta

SEQ ID NO: 13517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggagggggcctcatcctctgcatgagcc

SEQ ID NO: 13518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcaaggttcgaaactagaagcgagagt

SEQ ID NO: 13519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcaccggtacggcccggttgtatgggg

SEQ ID NO: 13520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcacgagagatgacgcggatttggcgt

SEQ ID NO: 13521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcacttccaccggagatgcaagcctaa

SEQ ID NO: 13522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcgaacgtggaaagttcgtaggaggtc

SEQ ID NO: 13523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcggtacccttcggtgacacgagacgg

SEQ ID NO: 13524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggctctatgcggttaagctcaggaagtg

SEQ ID NO: 13525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggctctgaattgtgggattaacggcctg

SEQ ID NO: 13526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggcttgacttcacgcgggtgtcgctcgt

SEQ ID NO: 13527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgggggagggcccggacaactacggatgt

SEQ ID NO: 13528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgggggtgtttgacagtcatgcacacgga

SEQ ID NO: 13529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgggtatggaatacttcggcttcctcgtg

SEQ ID NO: 13530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgggtgcacggctagtagccctagctcct

SEQ ID NO: 13531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgggtggaatgagatgctgaaggagtagc

SEQ ID NO: 13532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtaacaagtggtaggttaatatgttac

SEQ ID NO: 13533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtagcagcgagtttttgacgccgcacg

SEQ ID NO: 13534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtaggagctcctgatgcggcgtttcgt

SEQ ID NO: 13535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtcggaacggaagaagcgtaaacggac

SEQ ID NO: 13536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtctcggatatcgggatcaggggtctc

SEQ ID NO: 13537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggtgaacgtcgtggtgggcgtgcggtcg

SEQ ID NO: 13538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatggttcggtacggtacatgcgaccacccc

SEQ ID NO: 13539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtacgctgggggcttacaaacaggacac

SEQ ID NO: 13540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtatacgggccatcataaccacgatttg

SEQ ID NO: 13541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtatttcagcggatcgaattttgttcac

SEQ ID NO: 13542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtcaacataactaggttttctctcccaa

SEQ ID NO: 13543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtccaatcaaatgcaacgcggtggcttc

SEQ ID NO: 13544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtcccgggccaacagattcgttcgagtg

SEQ ID NO: 13545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtccgatgcagcatggaccgtcgtcaac

SEQ ID NO: 13546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtccgcagtattgtggctggtatgaagt

SEQ ID NO: 13547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtccgtggaaggcaggtgtagggccgcg

SEQ ID NO: 13548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtcgagtcacactcgtctaaatatgcgg

SEQ ID NO: 13549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtcgcgtgattcatgtatcgccggcgct

SEQ ID NO: 13550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtctactgttgatcatggccccgtgagg

SEQ ID NO: 13551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtctcattcgaagcgtcactcggggtgg

SEQ ID NO: 13552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtgatttgaccataaattttcaaagctt

SEQ ID NO: 13553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtgcacaggtgttgtggtctctggcgta

SEQ ID NO: 13554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgtgggcggattgggtcatgtggtgatgg

SEQ ID NO: 13555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttagaggagagctgtccgttctaacgg

SEQ ID NO: 13556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttcaaaagtcgggttgtagccgtggtc

SEQ ID NO: 13557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttcaaggccgggaagtaaggggaaggc

SEQ ID NO: 13558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttcgtgtttccatgattcaccggtcga

SEQ ID NO: 13559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttcttacttccgtaattgcacaccaat

SEQ ID NO: 13560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttgcggtaatagctttgtctgcagtgg

SEQ ID NO: 13561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatgttggcccgtgagtggttgccctagggg

SEQ ID NO: 13562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattaaaggaacgccgcgcaaacgaacagtg

SEQ ID NO: 13563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattaagtcaattcctgcgctgtgttaggta

SEQ ID NO: 13564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattaatgcggcatgtcaagcggagaggcgg

SEQ ID NO: 13565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattacactggtggccgccagagtgttactc

SEQ ID NO: 13566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattaccaacggtataatccggttgtcggga

SEQ ID NO: 13567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattacctgccagctggcgctgttttacgct

SEQ ID NO: 13568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattacgcggcaggtgtcgtttgtgctgttg

SEQ ID NO: 13569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattacttgatctatcggttagcttacatgc

SEQ ID NO: 13570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattagacagtaacgctgggccatatcatag

SEQ ID NO: 13571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattagacgcatctgagcgaaatcgagcaac

SEQ ID NO: 13572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattatatccgtgcaattatgtccatgacct

SEQ ID NO: 13573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattatcacggctgcatacaaagcggcgtaa

SEQ ID NO: 13574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcaactttggagccttttacagtgagct

SEQ ID NO: 13575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcaataatcatattaatttcggacgttt

SEQ ID NO: 13576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcacaaatctccgttaatgacgtacgaa

SEQ ID NO: 13577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcacagcaagttcattttttcagtttgc

SEQ ID NO: 13578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattccacgtgtgaaggtgtaagcttgagtc

SEQ ID NO: 13579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattccatgattcaaatgcatcgtaagtact

SEQ ID NO: 13580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcccgaaccgcttctcgatcattcgacg

SEQ ID NO: 13581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattccgtacgctcaatcgatgatcgcactg

SEQ ID NO: 13582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcgagcggagccatgtgacggtcaaagc

SEQ ID NO: 13583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcgggtcatgccaatgcgggccggactc

SEQ ID NO: 13584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcgggtgatgcatgcctggtgatacgta

SEQ ID NO: 13585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattcgtgatcatccacgagtatagttgtgg

SEQ ID NO: 13586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattctagttatctctcctcatcgggagact

SEQ ID NO: 13587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattctcctatgtcgcatattgtcttcttgg

SEQ ID NO: 13588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattctgctgcttatgaagggaaaggcgagc

SEQ ID NO: 13589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattctttgataggttagggccccgtttcgt

SEQ ID NO: 13590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgaaccggcatgcgccatctacttccct

SEQ ID NO: 13591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgacatgcgagtaactccgaatgttcaa

SEQ ID NO: 13592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgacccataccagggtgtactcgcatga

SEQ ID NO: 13593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgactacggatgataggttcatatcctt

SEQ ID NO: 13594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgagcaggtaaggtcgaaccccggctcc

SEQ ID NO: 13595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgaggctttacaacgcgaccctatttga

SEQ ID NO: 13596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgctacgcgttagctcatccagtatggc

SEQ ID NO: 13597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattggccgctttcccgtgattgatcggccc

SEQ ID NO: 13598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattggggcagttgcatcgggaccgcgccct

SEQ ID NO: 13599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattggtgaccgctaagacccgcagttctct

SEQ ID NO: 13600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattggtggcatgaatgcaggagtcgccagg

SEQ ID NO: 13601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgtaactggcctgttttataatggcact

SEQ ID NO: 13602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgtcagggaaagacgacatgcgtctggc

SEQ ID NO: 13603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgtggatattgacgaggttaggcacggc

SEQ ID NO: 13604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattgtttcattaacagtaccacagttggat

SEQ ID NO: 13605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttaaaacattgatgactgcgtgttctcg

SEQ ID NO: 13606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttaatcgttacttggaacgggcgggtcc

SEQ ID NO: 13607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttagaggcccccattgcgtcctttgcct

SEQ ID NO: 13608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttcagttcttgctatttctcgaaaattc

SEQ ID NO: 13609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttcgagagtactacgcacggttatgttg

SEQ ID NO: 13610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttcgttgttctatgtctttgggactttg

SEQ ID NO: 13611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttgctgcagtatgcctgttgcggagtgg

SEQ ID NO: 13612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caatttgggagtatagtggtcgagccacggcc

SEQ ID NO: 13613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caattttgatttgggcgctagagatagggtgg

SEQ ID NO: 13614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaaaagggcacttttcaggctcggcgaag

SEQ ID NO: 13615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaaatgcaggttcatcctctgacgtggtc

SEQ ID NO: 13616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaacatggtcgaaacgcgaggacctaccg

SEQ ID NO: 13617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaaccgcatttctaaggcgtgcaagtgtt

SEQ ID NO: 13618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaacctctcagtcggggcttactggagcc

SEQ ID NO: 13619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaaccttaggtccgtaggtgcaggatcgg

SEQ ID NO: 13620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaacgacggttcctggcttgcggaagggc

SEQ ID NO: 13621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaacgtaacgagcggggctagagcgtaac

SEQ ID NO: 13622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaactatcccggataatgatcttacacaa

SEQ ID NO: 13623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaactcaccgcgctagtgagagcccgatg

SEQ ID NO: 13624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaacttccaggcacccctgcgattcgacg

SEQ ID NO: 13625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaagcttaggttccggaaccccgtaagcg

SEQ ID NO: 13626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaaggttggtctcaagagcgccgcatttg

SEQ ID NO: 13627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaagtgtactcggttagttcaacgggggc

SEQ ID NO: 13628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaatataagtcctacgtccgttaacaagg

SEQ ID NO: 13629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaatcggtggcttggtcacgcgctctctg

SEQ ID NO: 13630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaatcgtatgtaggacgcagcgaaaacga

SEQ ID NO: 13631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaatctcggcgttgctgcattaagcggga

SEQ ID NO: 13632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacaacactaacacgtcaaagttaagggg

SEQ ID NO: 13633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacaaggatacgtccgtgcaccgcgtaca

SEQ ID NO: 13634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacacgggggggcgcctggtggttgtgtc

SEQ ID NO: 13635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacactaagagagttaggctttctcggcc

SEQ ID NO: 13636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacacttgttcctcagtacctgcgcagat

SEQ ID NO: 13637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacagacctagcttcatgtatctatcgca

SEQ ID NO: 13638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacattaaggcagcgatgtgatgagaatg

SEQ ID NO: 13639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacccaggattcgcctaggggttaggctt

SEQ ID NO: 13640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaccccggctccctctatcttgtcaaagt

SEQ ID NO: 13641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaccgatgttctccttatgctcagcgcaa

SEQ ID NO: 13642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaccggcttccaagttgactggacggatt

SEQ ID NO: 13643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaccggtaagacagcacaacggaagacat

SEQ ID NO: 13644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaccgtaccggagggggcccgcgccattg

SEQ ID NO: 13645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgatgcttgtgtgtttctcacaaatcc

SEQ ID NO: 13646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgccacgagcgagggaaaggctagtgc

SEQ ID NO: 13647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgcgatcaggcagcccaatgaccaccc

SEQ ID NO: 13648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgcggcatcccatggtctgcatgatta

SEQ ID NO: 13649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgctaggtgatgaggtaacagctatac

SEQ ID NO: 13650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgcttatcctctgtgcacgggaagatt

SEQ ID NO: 13651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacggacgtggaaaatttctgcgttacgc

SEQ ID NO: 13652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgggatataaataagtgctggctacgc

SEQ ID NO: 13653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgggcggactttgtttaccgcagcccg

SEQ ID NO: 13654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgggggggcactgatcgcggtgggttt

SEQ ID NO: 13655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacgggtgtgcggtactaggtcgaccgtc

SEQ ID NO: 13656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacggttcgcgtcctcgctcgaattcttg

SEQ ID NO: 13657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaactaaacctggctttgtgccgcatcttc

SEQ ID NO: 13658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaactaaccggttagcaacaatcaacatcg

SEQ ID NO: 13659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaactggagcgcatcgaaaacgcatccact

SEQ ID NO: 13660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaactggtagccgaatggagggatatggaa

SEQ ID NO: 13661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacttatgacatgggttcgtctgctacgt

SEQ ID NO: 13662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaacttccccggagatgccgttagcgatta

SEQ ID NO: 13663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagaggagtggacgatttcaactgggtgc

SEQ ID NO: 13664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagataggtgggggcaccaaaagctcctt

SEQ ID NO: 13665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcacagagaaagtgagcaaaatggagc

SEQ ID NO: 13666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcacggctacctggcttgatcccttcc

SEQ ID NO: 13667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcacgttttgcggtggcatctgttcgc

SEQ ID NO: 13668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcaggtggtaagggctgcatacgggta

SEQ ID NO: 13669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcccagcgcagtggtgggaagggaaga

SEQ ID NO: 13670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcctgactgctagaaatagcggggtct

SEQ ID NO: 13671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcgcaaaccccaacgtatcgtactttt

SEQ ID NO: 13672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagcttcagaccattaattgcaatgtgtt

SEQ ID NO: 13673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaggacatgccgcagagtgaaggttagcc

SEQ ID NO: 13674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaggattgtttgtcattcagcggggctca

SEQ ID NO: 13675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaggcgattcactctattttttggttggt

SEQ ID NO: 13676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaggcgggagacctgtatgcgccgctcgc

SEQ ID NO: 13677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagggacgtcttcggctttaacacgggga

SEQ ID NO: 13678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagggaggtgtgcgtcatacgtgttaagg

SEQ ID NO: 13679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaaggggacggaatattactcgacgcgcgt

SEQ ID NO: 13680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagggtggtaagtaaattggtacgacatt

SEQ ID NO: 13681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagtccgttcgtgcacagaacaagcggcc

SEQ ID NO: 13682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagtgcacaggtttccggtcccccagttc

SEQ ID NO: 13683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaagtgtcaatatcgtacacccatgctcat

SEQ ID NO: 13684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatacgactttatttaccgctccttcctt

SEQ ID NO: 13685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaataggccacgccagctacttcgtttttt

SEQ ID NO: 13686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaataggcccagccacgcagacgagtcgct

SEQ ID NO: 13687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatagtaccgggttgtactgcttggtctt

SEQ ID NO: 13688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatattccaaacctggtgcggatcaatca

SEQ ID NO: 13689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatcaggacacagagcgtttcgcgagact

SEQ ID NO: 13690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatccgacaacagttctgtaaacggtggg

SEQ ID NO: 13691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatccgacgaactggcgtcactcgttccc

SEQ ID NO: 13692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatccggaggtgctcaagtactaggagct

SEQ ID NO: 13693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatccgttgagggtccgtcatagataccc

SEQ ID NO: 13694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatcgtcatgaatcctgcaccaaggtttt

SEQ ID NO: 13695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatcgtgatacgaccggtcagtggtaagt

SEQ ID NO: 13696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatgacgtgtatggcactgctcggccact

SEQ ID NO: 13697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatgcgagttgatccgcgaggcatccatg

SEQ ID NO: 13698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatggcgcgtggggcatccgtcaggcttc

SEQ ID NO: 13699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatgggcaacgctgccattctggcgatac

SEQ ID NO: 13700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatggttggtctgataaaaccgtctgtcc

SEQ ID NO: 13701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatgtagggcgaattttttttgacacggt

SEQ ID NO: 13702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatgtccgttctgtgccaattgcactttg

SEQ ID NO: 13703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaattgcgccggcaccgcggcaagcatcga

SEQ ID NO: 13704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaatttgtgactgatcgagacttctagttg

SEQ ID NO: 13705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacaaaaaagatactgttaacgtgtgctgg

SEQ ID NO: 13706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacaagcccctatggcacccgtattgcgga

SEQ ID NO: 13707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacaatcaagcgaggtcagataattccgga

SEQ ID NO: 13708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacaaactgccggcgctgactgaacggg

SEQ ID NO: 13709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacactgcatcaagattagctcggtatc

SEQ ID NO: 13710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacaccacgacgaatagggtaaggctggca

SEQ ID NO: 13711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacccgcgtaagtggacccctaagtcta

SEQ ID NO: 13712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacccggcttcgctccttttgttctctg

SEQ ID NO: 13713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacctggtggcaggatgagcgaaacgtg

SEQ ID NO: 13714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacacgccagcaggttcgattcttgttgag

SEQ ID NO: 13715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacactcgactcgctagatccgggtccgta

SEQ ID NO: 13716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacagccggataacctcgacgtgctatcgt

SEQ ID NO: 13717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacaggccgaagcaaggcccatatcgcgcg

SEQ ID NO: 13718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacagtgcgcggcctgatatcacacggttt

SEQ ID NO: 13719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacagtgtaagaggcaatcggctaaaaagc

SEQ ID NO: 13720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacagttaccagagcaacacttcggatggc

SEQ ID NO: 13721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacataccacaggttctcatccataagcta

SEQ ID NO: 13722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatacccaggcctaatgacgcacgctac

SEQ ID NO: 13723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatacggcgtcctcgagactcggttccg

SEQ ID NO: 13724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatcgcgcttagctgtttcggtataatt

SEQ ID NO: 13725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatcgggcccctttttttgtcgtacaga

SEQ ID NO: 13726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatgcggcgtatttccgttctcaatggg

SEQ ID NO: 13727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatgcgtagccaaactgcattttggatg

SEQ ID NO: 13728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatggaaagcgtacacccggcggagtcg

SEQ ID NO: 13729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacatggagtctcgcgcgggcttggttttt

SEQ ID NO: 13730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccacgacatcatgaacaagcagttttcg

SEQ ID NO: 13731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccagcagctgagcaagtctcgcgtggtt

SEQ ID NO: 13732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccagcgtgaagtgggcaatgctactccc

SEQ ID NO: 13733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccataacggcacgagtcgtttcctcagg

SEQ ID NO: 13734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccatcgctgacgtagctcgactggagcg

SEQ ID NO: 13735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccatgaggtcacagagaacaggctgagg

SEQ ID NO: 13736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccatggcttggtttagtaaatctggtga

SEQ ID NO: 13737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccagatcgctcttgcgcccatgtttgc

SEQ ID NO: 13738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccaggctgtcggccttgtgtatcacgc

SEQ ID NO: 13739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccccacgggttgcacagtaaggaaatca

SEQ ID NO: 13740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccccgatgctcacagtacgtcgctcct

SEQ ID NO: 13741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccctatccatcgctcagcaacgtggtg

SEQ ID NO: 13742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccctcttaatatcgtactcccttgcga

SEQ ID NO: 13743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccgactagacgggagagttcgacacga

SEQ ID NO: 13744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccgatctttgcattcctgtccgctcta

SEQ ID NO: 13745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccgctttgttccgtcaaaggggcacgc

SEQ ID NO: 13746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccggagatagtaacccgtgtgtttgac

SEQ ID NO: 13747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacccggggcagatggccgcttttctggtt

SEQ ID NO: 13748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccctcgatcgcgtctcgtgtctgctcgg

SEQ ID NO: 13749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgaaaaagcgtcacgggtcaggcactt

SEQ ID NO: 13750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgagggacaactatgacgcgaccggat

SEQ ID NO: 13751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgcgacaggacacaccttaccgggcct

SEQ ID NO: 13752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgcgttaatgcctaaactgcgcccggc

SEQ ID NO: 13753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccggaccctgtgtcgggtcttgacactg

SEQ ID NO: 13754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgggtcgctatttgtgatcgtaggggc

SEQ ID NO: 13755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccggtcgttgcactctgaaccatctctg

SEQ ID NO: 13756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccgtatgtcaactccaggtttcccacgt

SEQ ID NO: 13757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacctgagggaagtaccttgtcgaatcttg

SEQ ID NO: 13758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacctggggatttggtgctgttccttctgc

SEQ ID NO: 13759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacctggggtctatttcagtttctagggga

SEQ ID NO: 13760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccttaatagtcattgataattcttaagt

SEQ ID NO: 13761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccttcatgcaaatccttagctgccagta

SEQ ID NO: 13762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaccttgttagctctgtcttgtgcatcggt

SEQ ID NO: 13763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacctttcacacgcctattggacattctgt

SEQ ID NO: 13764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgaaagcttctgatacgtgctgcatgtc

SEQ ID NO: 13765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgacgaacgagatatatgcaggtttcgg

SEQ ID NO: 13766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgacgaatgtcttgggcatccgaacggc

SEQ ID NO: 13767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgacggtacggaaatggctgtaactgcc

SEQ ID NO: 13768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgactctttgagacgtctggtgtagttg

SEQ ID NO: 13769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgactgggtggtggtggcgcctcttgta

SEQ ID NO: 13770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgaggtgggacagtgtaggtggaagagt

SEQ ID NO: 13771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgagttcagcagctcaaggcaggcaggt

SEQ ID NO: 13772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgataatggtgcaagaatcgcttgggcc

SEQ ID NO: 13773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgatctgcgtgaataatgtgttccgtta

SEQ ID NO: 13774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcaaaaacgtagaaggcccagagctgc

SEQ ID NO: 13775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcaacgatcaggcactactaaagaggt

SEQ ID NO: 13776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcaattacactagggcactaaagtagt

SEQ ID NO: 13777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcacatctgcaaggcggctacgaggac

SEQ ID NO: 13778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcagagctgaccatggccagtgtcgtt

SEQ ID NO: 13779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcatagcttccgtacctcgtcattgga

SEQ ID NO: 13780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgccgtccgtactgtgccggaaggcatt

SEQ ID NO: 13781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcgagaccgggtatgcacgagtggctt

SEQ ID NO: 13782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcgtctgaccatggctaataagcgttt

SEQ ID NO: 13783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcgtgtatattgacggacaacgtagtg

SEQ ID NO: 13784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgctacgaactgtcagagctccaaggaa

SEQ ID NO: 13785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgctggtcatcttacgtatgaggttcga

SEQ ID NO: 13786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcttcccaggttattgggtttcgcgat

SEQ ID NO: 13787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgcttggcactaccagtacagctgatta

SEQ ID NO: 13788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgctttttcgctcaggcttacagttcta

SEQ ID NO: 13789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggacgtatggaacagcaccgccttgga

SEQ ID NO: 13790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggaggtaccactgacgctaatggttaa

SEQ ID NO: 13791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggcaaattatgaccgcggtcgcttcga

SEQ ID NO: 13792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggcgaaaggtgggttatgccgtatctc

SEQ ID NO: 13793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggcttaatgcgacattgcgtccgagtt

SEQ ID NO: 13794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggcttactactggctttgcaaggacgt

SEQ ID NO: 13795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgggagcctttcggagaggtggagatcg

SEQ ID NO: 13796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgggctcgacaggattgcggtgggtgcc

SEQ ID NO: 13797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggtcagcaggcaagctgtggatcgctt

SEQ ID NO: 13798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggtcgccgcgagccggaccatctgcgc

SEQ ID NO: 13799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggttcatgttacgcgtgagcaatggcc

SEQ ID NO: 13800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacggttgacgcttcggacccgatgagagg

SEQ ID NO: 13801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtaaggcgccctataattatggtgcgg

SEQ ID NO: 13802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtaatgagttggccgcgtggagtgagt

SEQ ID NO: 13803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtcacgacgaccgcaagtcccctctcg

SEQ ID NO: 13804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtcttggagtcaatcagtatgtagtcg

SEQ ID NO: 13805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtgctagaacggacccagggagggttg

SEQ ID NO: 13806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgtgcttatttcctcgtcgcacgcgcat

SEQ ID NO: 13807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgttagagaatacatgtacttcttatcc

SEQ ID NO: 13808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgttcgcagctttgctcaggtgccactt

SEQ ID NO: 13809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacgttttgtatagagtctcaggaggcccc

SEQ ID NO: 13810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactagaccgcactgcagctcccttctatc

SEQ ID NO: 13811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactatcggaccgggttcctttggtttgca

SEQ ID NO: 13812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactatctcgagctattcgttcggtaccgt

SEQ ID NO: 13813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactatgccggatcaattggagtgaagcgt

SEQ ID NO: 13814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcacacgcggtgcagtctcctcatcgt

SEQ ID NO: 13815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcccttttacatcgcggaatcagtttt

SEQ ID NO: 13816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcgccagtaactggttctccgcacggc

SEQ ID NO: 13817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcgcgggtctaggcttgggaggatgcg

SEQ ID NO: 13818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcgctgatgcagcgcatccaccgtgaa

SEQ ID NO: 13819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcggctttgggctattcagcaagcagt

SEQ ID NO: 13820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcgggtcttatgcccgtcgccatcatc

SEQ ID NO: 13821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactcttagccacgtttgtccagccatcta

SEQ ID NO: 13822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactgcacgttggtcactctagttgtgggg

SEQ ID NO: 13823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactgcgcggggatagtaactctctccagc

SEQ ID NO: 13824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactgctctaacggcgtgagttcgtacgtc

SEQ ID NO: 13825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactggcaattttatctctatgctgctttt

SEQ ID NO: 13826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactggtcagtcaggacctcttctcgggga

SEQ ID NO: 13827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactggtgggttatcgtggagggttatgac

SEQ ID NO: 13828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttaatctcataactatatacgtcagta

SEQ ID NO: 13829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttactccgctatcacaggttattcagg

SEQ ID NO: 13830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttccgcgcgtactctacatgggcatcg

SEQ ID NO: 13831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttccggacacttactcgcgagctgggt

SEQ ID NO: 13832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttgaagcagaacgtagcccgggggttg

SEQ ID NO: 13833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttgccgaatctggactttcgtgtgctg

SEQ ID NO: 13834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactttcagtgcaaccttctgccccatgcg

SEQ ID NO: 13835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactttgacagcccttatagagccgtgtgg

SEQ ID NO: 13836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacactttgtgggactcgggttcgttccctgt

SEQ ID NO: 13837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacacttttctctgcactcaagcatagaccgg

SEQ ID NO: 13838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaacaagcgcacgatgcctcccggcccg

SEQ ID NO: 13839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaacatcttcttcccgcttacacaagct

SEQ ID NO: 13840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaaccggctgacagcacatccccaatcc

SEQ ID NO: 13841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaagtatgtagtaacagcgtcataccgc

SEQ ID NO: 13842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaatggcggaagcgcgtggtcatgggac

SEQ ID NO: 13843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacaggaaaggtttagtgcagttcctca

SEQ ID NO: 13844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacccgcctcttcgcccctactgctggc

SEQ ID NO: 13845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaccggggtcatattagtgggctcactc

SEQ ID NO: 13846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacctctcctgtgaacgggtcaaccgcg

SEQ ID NO: 13847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacgaaattaggcattcatctcattacg

SEQ ID NO: 13848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacgtagtacgttgtgacgcgtggtctg

SEQ ID NO: 13849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacgtcctcgtatagtggtatttaaccc

SEQ ID NO: 13850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagacttgaggcgggtcgcgtgccacaacg

SEQ ID NO: 13851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagagaggtggacaggcaattggccccccc

SEQ ID NO: 13852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagagcagcgagaatggggatgaaaatcgg

SEQ ID NO: 13853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagagccaatcacacccgacgtaaggttag

SEQ ID NO: 13854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagaggtgctaccgctgacacggttggttg

SEQ ID NO: 13855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagagtaggaatgctcttaccttgttggcg

SEQ ID NO: 13856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagagtcttggtggttcagcggccaatctg

SEQ ID NO: 13857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagatcaagctgggtcgaccgcttgtgtgc

SEQ ID NO: 13858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagatgttttgactggttctatggtgtttg

SEQ ID NO: 13859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagattagagcccatggtacagtccgtgta

SEQ ID NO: 13860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagattcggagtatcattatctgcggctaa

SEQ ID NO: 13861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcaaacaggaaggctcggaaccccggca

SEQ ID NO: 13862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcaagcatgatgttctggtgaactcatc

SEQ ID NO: 13863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcacggcaagcagccagggaccgagcac

SEQ ID NO: 13864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcactgctagacgggctaccatagtcat

SEQ ID NO: 13865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcagctgcccccactcacggtatttagt

SEQ ID NO: 13866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcaggttacgcgctattactcggttgtg

SEQ ID NO: 13867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcatgaacgcttgcttgcggtggtactc

SEQ ID NO: 13868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagccaacgttgcgcttctcattcgtccct

SEQ ID NO: 13869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagccaagtattttatcgggctaagaagcc

SEQ ID NO: 13870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcccactgcggacaagtttggggaaccg

SEQ ID NO: 13871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcccgtgcatcttcagtaccatcaacgc

SEQ ID NO: 13872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagccctcatgcctttacgacttttaatgt

SEQ ID NO: 13873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagccgcattatggcttagcggttccaggt

SEQ ID NO: 13874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagccttgaccatccgcggccgataacagg

SEQ ID NO: 13875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgagggcatcctttccaataaaccgtc

SEQ ID NO: 13876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgagtcattggcaagcgtacacgtgct

SEQ ID NO: 13877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgcccactcgtgttacttctcccgcta

SEQ ID NO: 13878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgcctgaggcttctgagcgcgcttcga

SEQ ID NO: 13879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgctctcatgttgacccggcgatttct

SEQ ID NO: 13880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgctgacagtcatgttctcctgtttgg

SEQ ID NO: 13881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcggagggtaagccacactctccggctc

SEQ ID NO: 13882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcggcccggcaatcaaagattggggata

SEQ ID NO: 13883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgggcgtttatcgggcacggtctcccg

SEQ ID NO: 13884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgggttaaatatttgcgtcgtgacggt

SEQ ID NO: 13885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcggttgtgatggttagtgttccgtggg

SEQ ID NO: 13886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgtcacagttgtgggacttccaggctg

SEQ ID NO: 13887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgtcgtcttggtcgctggtctgaaggc

SEQ ID NO: 13888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcgtgggtgaaactatagcaccctaagt

SEQ ID NO: 13889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagctcaatcaggtcctctttcgttcgcgc

SEQ ID NO: 13890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagctcccccttacagccaacttcggatgc

SEQ ID NO: 13891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagctggaagttgacatgcgtgctaacgat

SEQ ID NO: 13892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcttcagtgaccggtggattgatcacgc

SEQ ID NO: 13893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagcttctgggggcccttagcggcacaaca

SEQ ID NO: 13894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagctttggtctctagattttgtactaggt

SEQ ID NO: 13895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggaaccggtgtacttttgaaacgttgtc

SEQ ID NO: 13896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggaacctctcgcaaccgaggacgatccc

SEQ ID NO: 13897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggacgtcgtagagcctctctcgccagtt

SEQ ID NO: 13898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggactcagtctcaagcgaattccgtcgc

SEQ ID NO: 13899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggagcggacatcagaagcgggaacagtg

SEQ ID NO: 13900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggaggacgcgatttcggatactaggacc

SEQ ID NO: 13901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggagggacgtagatcatgtgctacggtt

SEQ ID NO: 13902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggaggggtgccatccatccttgctcttc

SEQ ID NO: 13903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggcatcatcgttgcggaacagaattcat

SEQ ID NO: 13904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggcatccgaggtcgttagtcttacactc

SEQ ID NO: 13905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggcattagggaacagacaccgttcatac

SEQ ID NO: 13906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggcgcaattcggggtagtcaggtttagc

SEQ ID NO: 13907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggcttccgtttgttaggttcgataagat

SEQ ID NO: 13908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggaccagcaagggttttacctcgtatt

SEQ ID NO: 13909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggatacagtaaaaagtcaacgcaactc

SEQ ID NO: 13910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggcaccgaagaaagactcagtgcgggt

SEQ ID NO: 13911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggcatggcaggtccaaacgtaattggc

SEQ ID NO: 13912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggcggagagcggactcgtggggcttgc

SEQ ID NO: 13913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggggaaaccgccgggtacgtctcttctt

SEQ ID NO: 13914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggggctttatcctcgattttcagtgggg

SEQ ID NO: 13915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggggctctggctcaccttagttgcaaa

SEQ ID NO: 13916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggtcgcctgcttacagaccagagacgg

SEQ ID NO: 13917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggtgtaccaggcagctcatcagcgtat

SEQ ID NO: 13918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagggttagtaagccgtttcctcgtcgcgc

SEQ ID NO: 13919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggtaccgcaaggtaggtgtgagtctccg

SEQ ID NO: 13920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggtggaacggtttcgcctctcctaagcg

SEQ ID NO: 13921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggtgtcggactggtcttgtgcgagcggg

SEQ ID NO: 13922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggtgttttcatacacgtcggatccgagt

SEQ ID NO: 13923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggttacttcctggaggtatcccttgtag

SEQ ID NO: 13924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggttgcgcgacattcaggttttgcaaat

SEQ ID NO: 13925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacaggttttatgatatttgaattttgagcgc

SEQ ID NO: 13926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtaaatgatggatcggatcgccgggcaa

SEQ ID NO: 13927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtaaccagggacacccctttgtggtgat

SEQ ID NO: 13928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtaagcaggagtggtccggaaattcggc

SEQ ID NO: 13929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtaatctgtcaatagggggatgttcagg

SEQ ID NO: 13930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtaattggctgcagatgtgtccgctcca

SEQ ID NO: 13931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtacatgaggggctttacgggctaagcg

SEQ ID NO: 13932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtacgatttgatcgcggtcactcccgcg

SEQ ID NO: 13933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtacggacaacagcggctgtgggacagc

SEQ ID NO: 13934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtagagaccatcccatttaccggataat

SEQ ID NO: 13935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtagcgagcagggttgtctgccccgagc

SEQ ID NO: 13936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtcatgacatcctctccgacagaggtca

SEQ ID NO: 13937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtcgccacaggtcattccaagcgattga

SEQ ID NO: 13938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtcgtcaagaggcctcacagtcggttat

SEQ ID NO: 13939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgaaaggtcgccctctgggactacggg

SEQ ID NO: 13940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgaacaatagcgcggggcacggacatt

SEQ ID NO: 13941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgaccagaggcaccgtgtccagccctg

SEQ ID NO: 13942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgaggacagtacttttaatccgtatac

SEQ ID NO: 13943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgcagccatggcggataagcgcgatgg

SEQ ID NO: 13944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgccgaggagagagcgatgtcagtctg

SEQ ID NO: 13945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgcggggaactcatcgcctttcgagat

SEQ ID NO: 13946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtggacgcgctcgaacctgcctacacgc

SEQ ID NO: 13947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtggctctttcacttcacttcattttct

SEQ ID NO: 13948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtggtatagggccaggccgcgccgtaaa

SEQ ID NO: 13949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtgtgtagcatggcggcatattgttgct

SEQ ID NO: 13950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagttaccccacaactatgtgagctaaagc

SEQ ID NO: 13951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagttatgagtgtttctagaggtatttgct

SEQ ID NO: 13952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagttgttaatgctctcacagtcattacac

SEQ ID NO: 13953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacagtttgggtcggcctgggtaactctgggt

SEQ ID NO: 13954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataaacacagctgggtggccgacattgcg

SEQ ID NO: 13955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataaggcctcttgtgtatagcactgttga

SEQ ID NO: 13956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataatgccaatgcaatacctgcctttact

SEQ ID NO: 13957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatacatgccgcatttcgggcgtatctcgg

SEQ ID NO: 13958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataccctccctgttacttaggtcgccttt

SEQ ID NO: 13959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataccgcggagtcgtcgatcgtgcgatcc

SEQ ID NO: 13960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatacctcccgcactgggcgacaggttccg

SEQ ID NO: 13961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatacgatcccatggattaactccacaagg

SEQ ID NO: 13962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatactttcgagacaggtgttgttcgctcg

SEQ ID NO: 13963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatagaccgctgtataaagatgtcacgact

SEQ ID NO: 13964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatagagcgcagatcgggtgaggcccgtgg

SEQ ID NO: 13965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacataggtggaatcggcacaagacccaaacc

SEQ ID NO: 13966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatagtctgctcccggagttcgatgaggcc

SEQ ID NO: 13967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatataacggagcatcagcgggagatttgc

SEQ ID NO: 13968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatatcatccatgagcagggcgtatgcg

SEQ ID NO: 13969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatcgccccgtagttccgcgtgcagttg

SEQ ID NO: 13970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatcgtgattcctctgccagtatctagg

SEQ ID NO: 13971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatctcaactttcagcgtggtagcgacg

SEQ ID NO: 13972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatgcaattataacttacttcggttccg

SEQ ID NO: 13973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatgcgagtggcgcgcgtctaattgtat

SEQ ID NO: 13974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatgcgtggaatggagacaagccacagg

SEQ ID NO: 13975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatggacagtggatcgctctccagactc

SEQ ID NO: 13976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatatgttttgatgatgaactctcggtgca

SEQ ID NO: 13977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatattaagtacagccagggagggatgcat

SEQ ID NO: 13978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatattcaagtcaatcgatgttcgccgtag

SEQ ID NO: 13979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcaaatggctttgtttgttggtttctca

SEQ ID NO: 13980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcaacgaccgggtgtaatcgcgtggcgt

SEQ ID NO: 13981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcaacgctacggaccgcagctagttacg

SEQ ID NO: 13982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcacccctggcaatcgggttcatgtcgt

SEQ ID NO: 13983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcacgcccacctccgttccgctgacgac

SEQ ID NO: 13984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcactcaatggggctagatgatcggcac

SEQ ID NO: 13985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcactgatgaactgtcatgcgaatacgc

SEQ ID NO: 13986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcagacggtcgcattgacgttgtggaca

SEQ ID NO: 13987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcagcgcgtggacatacgtgttgccgca

SEQ ID NO: 13988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcagtagtgaatggtggttagccggcgc

SEQ ID NO: 13989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcatgcttaaattacaagcgttgcggca

SEQ ID NO: 13990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcattctgtagtcccttggatcttggat

SEQ ID NO: 13991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatccaaatatagttgcgctacatattagt

SEQ ID NO: 13992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatccaggtgtacagtttcaactttggtta

SEQ ID NO: 13993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatccgcagtgattgagacatcgtatccac

SEQ ID NO: 13994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcctaacaatcaatgtcctcaatgctga

SEQ ID NO: 13995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcctgagcggcgagcgctccactaaatg

SEQ ID NO: 13996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgaggaagcgccgacacacgtgtgtat

SEQ ID NO: 13997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgatacttgtgtttaaagttagtagcg

SEQ ID NO: 13998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgcacctcttgaattgccaggactccc

SEQ ID NO: 13999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgcccgtaaacacgcaggtttcatgga

SEQ ID NO: 14000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgcctagtgatgcaacggtcggctgtt

SEQ ID NO: 14001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcggtttttgttcgagagagcatctacg

SEQ ID NO: 14002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgtcatccacgcgatcagccaggggcg

SEQ ID NO: 14003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgtcgactccgggtttccactccagaa

SEQ ID NO: 14004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcgttgcaagctctggttcaagcttcgg

SEQ ID NO: 14005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatctgggagtgtctgccgtccggtgacgg

SEQ ID NO: 14006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatctggtattgtactcgttttcgtgatgt

SEQ ID NO: 14007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcttaatcatggtggggctgccgaagtt

SEQ ID NO: 14008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcttcaaccagtatcttattccgagaat

SEQ ID NO: 14009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatcttcatcgtaaggcggctctgcgatac

SEQ ID NO: 14010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgaagaattggccattatgttcacactg

SEQ ID NO: 14011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgaagccaacgggcaagacgggtgggcg

SEQ ID NO: 14012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgacaagtcagacaacaaggggtaccgt

SEQ ID NO: 14013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgacctctctaagacgctctcgtatagc

SEQ ID NO: 14014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgacgaagcagggtatgctttatgcagc

SEQ ID NO: 14015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgactgttggatcgtcttaatgccaacg

SEQ ID NO: 14016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgagaccgttaccaaagaatggctccta

SEQ ID NO: 14017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgagcaaaagtgagtacatgtaaacaaa

SEQ ID NO: 14018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgagttatgctgcactcagagtacgtgg

SEQ ID NO: 14019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgatcggcatgcgttttgtagagtgctg

SEQ ID NO: 14020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgatgggaggttcacttcccgaaggggc

SEQ ID NO: 14021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgcagcgacgtacgtaggaaccagttgg

SEQ ID NO: 14022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgcatctgttactgccagtcgccagggt

SEQ ID NO: 14023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgccatcgacctgccgcttatattcgat

SEQ ID NO: 14024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgccattacgggacgtgcttgcgccaag

SEQ ID NO: 14025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgccccctttcgcagtcttcggagagcg

SEQ ID NO: 14026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgcctcactacattccttagtcttcctg

SEQ ID NO: 14027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgctggccatcacatattgtattgtgaa

SEQ ID NO: 14028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggagaactgtttggatgtttcgccgga

SEQ ID NO: 14029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggattagcggtttgcactacgaccgcg

SEQ ID NO: 14030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggccccgtgttacaggtaggttcctgc

SEQ ID NO: 14031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggccgtcccccataggtgcgacgttgt

SEQ ID NO: 14032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggctgtgcacctcacccgtaccgagag

SEQ ID NO: 14033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgggccatatcggtccacgcttgatctg

SEQ ID NO: 14034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgggtattccgtggatcgatctcatggc

SEQ ID NO: 14035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatggttctttgcgagtaggttttggccac

SEQ ID NO: 14036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgtagagcagcagtatttgtaatggact

SEQ ID NO: 14037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgtaggggcaacatgatgagtgaagctg

SEQ ID NO: 14038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatgtatgggggaatccctgggctctgagc

SEQ ID NO: 14039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattaatccataattagggctttcaggttc

SEQ ID NO: 14040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattaatcctacaatccttctgatcggaca

SEQ ID NO: 14041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattaccccaactcggacctgatgctgggg

SEQ ID NO: 14042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattagggttgtgtcccggcggtgggatgc

SEQ ID NO: 14043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattatggggcgactttatacactgactgt

SEQ ID NO: 14044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattccaagatggactcgttatgctgacct

SEQ ID NO: 14045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattcccggtaatcttagtcacctcattcc

SEQ ID NO: 14046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattcgtattgacgtgcagctgaacatgat

SEQ ID NO: 14047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattctagtctaatggcgtctcttgcggga

SEQ ID NO: 14048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattctattggtgtgtatgatgtaccgtgt

SEQ ID NO: 14049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattctgtagtactcagacctaacttgccg

SEQ ID NO: 14050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattgggatctgtgtagtggtctggcacgc

SEQ ID NO: 14051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattgtacatgtatgcggccggataggggt

SEQ ID NO: 14052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttagcatgcgcagttacgcgtccgaat

SEQ ID NO: 14053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttattgcaaccacactgtgaggccgcc

SEQ ID NO: 14054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttcacgggtgcctggtagcgggctcat

SEQ ID NO: 14055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttcccaaggaatcgctggagggctact

SEQ ID NO: 14056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttgactcgcagcccactgtcttgcgtt

SEQ ID NO: 14057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttgcacacacaggtggggtccgttggg

SEQ ID NO: 14058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttggcacgctcgactaaggtcgctccg

SEQ ID NO: 14059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttggctgcgacaggtccgggtagttgt

SEQ ID NO: 14060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacatttgttgtcggtttcatggtgttggacg

SEQ ID NO: 14061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattttacctgcgttcagaatgatgccttt

SEQ ID NO: 14062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattttagagctgagggcaacgcgcgagag

SEQ ID NO: 14063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacattttgtaacccggtctgcacctaactcg

SEQ ID NO: 14064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaaactagtctaatcactgaaagtgtact

SEQ ID NO: 14065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaaactgtagctaactgttttcttgaaca

SEQ ID NO: 14066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaaagcaaaaacatttcgggtcgggtagt

SEQ ID NO: 14067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaaatacggatggggcagccgtttgatgc

SEQ ID NO: 14068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaaatgacgcatgtagcatgagttgcggt

SEQ ID NO: 14069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaacaagcctgaggttagggtgcttcgtc

SEQ ID NO: 14070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaacgcctaattccgccggacgggcaatg

SEQ ID NO: 14071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaacgggaccgcgcgttcgggacggctcc

SEQ ID NO: 14072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaacgtaaaggagacggtacagccgcttt

SEQ ID NO: 14073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaactacccgctcccctgctgtttatttg

SEQ ID NO: 14074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaagacccgttccaggtatcgtgcggctg

SEQ ID NO: 14075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaagtatcaactgggcgctttccacattg

SEQ ID NO: 14076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaagtcacacacgaatgattctatatacc

SEQ ID NO: 14077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaagtgagacttgccgcagggcgagtttc

SEQ ID NO: 14078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaatcgggcgaactgggttgtgtgcagcg

SEQ ID NO: 14079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaatctgtgcaattcgagcttaagtccct

SEQ ID NO: 14080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaatgctggactctttcacggttggttga

SEQ ID NO: 14081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaatggcgaggatagggtgtttgctgcga

SEQ ID NO: 14082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacaacgcacggatgggatggataaccgc

SEQ ID NO: 14083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacaccagctttggcaaaggggaatagca

SEQ ID NO: 14084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacacgagattgggcgtgtttggcttttt

SEQ ID NO: 14085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacagctaaatggctcgagcgaccgggtc

SEQ ID NO: 14086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacatcggggcgttcatcacatggacgac

SEQ ID NO: 14087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccaacgtgttacgcaaaggtggactgc

SEQ ID NO: 14088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccaagagaggggatgggcttcataacg

SEQ ID NO: 14089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccacgccgcccacggcggtcatagttc

SEQ ID NO: 14090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccactctcctccttgtttaacttgggg

SEQ ID NO: 14091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccgacagatcgtggcgatgggatttcc

SEQ ID NO: 14092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccggttcgacgtttcaccccgtgtacg

SEQ ID NO: 14093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaccgtatactttctgttgccatagatag

SEQ ID NO: 14094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacctttgttctgccatgccttgccatgc

SEQ ID NO: 14095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgaatggactctgcgacactttttcgc

SEQ ID NO: 14096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgactgtagtgtgagtgcgccgtctat

SEQ ID NO: 14097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgattgtagtcaccgcggacagctggg

SEQ ID NO: 14098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgcaccagattcgagtggtccagtatg

SEQ ID NO: 14099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgcatacttttcaccctcactggaacg

SEQ ID NO: 14100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgctgacaaacggaggtaggaatggcg

SEQ ID NO: 14101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacggcggtgcacgcatcgggccttagaa

SEQ ID NO: 14102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacggggcagttgacagccgacagcggtg

SEQ ID NO: 14103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgggtgtctgaatgttgcctccggcgt

SEQ ID NO: 14104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacggtggcaccgaccctcgttgtctcat

SEQ ID NO: 14105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgtcagtgtcgcaacgggctccgtcca

SEQ ID NO: 14106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgtctgacccggctgcaatgctgttga

SEQ ID NO: 14107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgtctttgcgctaaggtgatcgccctt

SEQ ID NO: 14108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacgttcaaaccagcccttactctgcaac

SEQ ID NO: 14109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccactaacagcctgctttattggacaatcg

SEQ ID NO: 14110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccactatcatctgcgtatcaccaatccatg

SEQ ID NO: 14111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccactccggtacgtgtatcctcccgcttac

SEQ ID NO: 14112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccactgagacatgaggaatttgctctcctc

SEQ ID NO: 14113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccacttggcgtgaggacaacccgcgacgtt

SEQ ID NO: 14114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagactgggcctcagttatgatgaattca

SEQ ID NO: 14115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagaggctatacgtcaagtccacgcttgg

SEQ ID NO: 14116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagcataacgcaggcccttcaaacagcgc

SEQ ID NO: 14117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagccttgtataaggcgcgggtcaatcgg

SEQ ID NO: 14118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagcgtttgttctaaagactcaccggtag

SEQ ID NO: 14119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagctcgacacgggcaatatgatcacctc

SEQ ID NO: 14120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagctgccgcacccagtccgatgcggtcc

SEQ ID NO: 14121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagcttaggtatgccggcgaagattacgt

SEQ ID NO: 14122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggggagtaaggtggcgcgcgagctcct

SEQ ID NO: 14123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggggctgctgcctggctaggcttcctt

SEQ ID NO: 14124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggggtattatatagtccttattttcgt

SEQ ID NO: 14125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagggtcatttgtttttgtgagacttgga

SEQ ID NO: 14126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggtatccagctttcagtcgctctcttg

SEQ ID NO: 14127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggtccgaagaccagggggaaaagggtg

SEQ ID NO: 14128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccaggtgtcagtgatagactatgccgcacc

SEQ ID NO: 14129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagtacatcaaacggggttccagagagcc

SEQ ID NO: 14130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagtagtgttaaagcgttcgtgtcacggt

SEQ ID NO: 14131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagtcttccgactcgacgaggcttggtcg

SEQ ID NO: 14132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagtggcagaaaagtgttggactcttccg

SEQ ID NO: 14133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagtgttagagtacgtgcgtgcaggtgag

SEQ ID NO: 14134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagttagttggtctggaacccgctctgac

SEQ ID NO: 14135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagttcaggatcggttggggcgccgcgtt

SEQ ID NO: 14136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccagttcgtgtactcggaagataatctcat

SEQ ID NO: 14137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccataccttcgtttacacgtatagcaccgg

SEQ ID NO: 14138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatacgagcctatggttcgcacgctcagc

SEQ ID NO: 14139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccataggcgttccagtactcgtcattgcac

SEQ ID NO: 14140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatatccgtgtggagcaggtgtacgaggt

SEQ ID NO: 14141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatatgaccgggcgtgtcggggtgacgac

SEQ ID NO: 14142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatcgacattacactctgctcctgggctg

SEQ ID NO: 14143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatcgctcacagtcctgatgcgtcggaca

SEQ ID NO: 14144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatctgtcggggagcaacttcttcgtctt

SEQ ID NO: 14145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgaagcagtgtccgaagtacacgggaa

SEQ ID NO: 14146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgcacccgtttgagacttgtggagtct

SEQ ID NO: 14147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgcacgttgcgcacctcctcccttacc

SEQ ID NO: 14148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgcatgtcgaggcaccttccggagcgt

SEQ ID NO: 14149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgccagggcggagagccgtagcacgcc

SEQ ID NO: 14150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgcgatgtatgacattttggatcttcg

SEQ ID NO: 14151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgctttaaggatcactattgcagcgcg

SEQ ID NO: 14152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgtcgatgggattaggaactatttcgc

SEQ ID NO: 14153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccatgtggacctctgcactctgtaggtgta

SEQ ID NO: 14154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattactcgctcggggtctcctaagatag

SEQ ID NO: 14155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattccgccctaacagtagggatttaatc

SEQ ID NO: 14156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattcgcagcagcgatttctccccatatc

SEQ ID NO: 14157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattgaagtcgagcctacatcttgatttc

SEQ ID NO: 14158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattgatcaaaagtttggttacgtgcttg

SEQ ID NO: 14159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattggtcagtccttaaccgagtgctgag

SEQ ID NO: 14160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccattggttgcagcagcgtaaactcggcca

SEQ ID NO: 14161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaaccggggcactgcgctactttgaggt

SEQ ID NO: 14162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaacgaaggggattttcactactggctc

SEQ ID NO: 14163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaagcattatcgatatctgaatgcgcac

SEQ ID NO: 14164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaaggcagaacggaggagacgaggattc

SEQ ID NO: 14165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaatacgctatcaccgcaaggggcaaga

SEQ ID NO: 14166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaattgccttcgggatggcaggcttctg

SEQ ID NO: 14167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacaaagatgaatacgtggttaggcggt

SEQ ID NO: 14168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacaactccaggactccggcagtggagg

SEQ ID NO: 14169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacacttagacaaggacgacgcttctat

SEQ ID NO: 14170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacccacggatggcgaagacaatactac

SEQ ID NO: 14171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacgcgcacatttggacacggtgcattt

SEQ ID NO: 14172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacgtcctgtttgacaactattccggcc

SEQ ID NO: 14173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccacttatgctgaaccttgtgccctgagc

SEQ ID NO: 14174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccagatggtcaaggggaaccgtgcctccg

SEQ ID NO: 14175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccagattctgaacacttggggtttcgtgc

SEQ ID NO: 14176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccaggcggccgtccaggtggttggatcac

SEQ ID NO: 14177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccagtcagcctagcatcgtatcacccgat

SEQ ID NO: 14178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccagtcagggttgtggtgcggtctgaccg

SEQ ID NO: 14179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccatatgcatgctagatgccagtgaagcc

SEQ ID NO: 14180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccatcgcgatctagggggggatcctgtcc

SEQ ID NO: 14181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccatggctgatgccggtttgtccctcttt

SEQ ID NO: 14182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccaatgtgttattcggagctttggaccg

SEQ ID NO: 14183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccacggggtcgtcgatgggcactagtcg

SEQ ID NO: 14184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccattatgacaggcaccctctgatgggc

SEQ ID NO: 14185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccccaaatgaccggtcttggaacctttct

SEQ ID NO: 14186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccccatactaatcacgccggcatgtggct

SEQ ID NO: 14187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccccttgtcatgacatggctcgatgtgt

SEQ ID NO: 14188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccccgatgagacctctgaaacatgtctgt

SEQ ID NO: 14189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccccgtcccgatagatggctccctcacat

SEQ ID NO: 14190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccgaggatgtgcggcagaaggtgtgctg

SEQ ID NO: 14191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccgctcaggtcacgctactgcaatcctg

SEQ ID NO: 14192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccggaggatcgggtcgtccagtttctac

SEQ ID NO: 14193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccgtcaggagggtcgtcgatcgagttaa

SEQ ID NO: 14194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccctccgtgtgtaatgtttatttcgtatt

SEQ ID NO: 14195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccctcgtgactgcgtttttggagaaatcc

SEQ ID NO: 14196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccctctgttatcagtgttattccgccgct

SEQ ID NO: 14197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccccttcttaatacgcgacgctcgctcgtt

SEQ ID NO: 14198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgaacgatgaggaacatttgggttttgt

SEQ ID NO: 14199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgaatgctatgggaggacggggttcggt

SEQ ID NO: 14200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgagcaggctcaagcgacacgaacggca

SEQ ID NO: 14201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgagccgattgttcatgatggatggtgg

SEQ ID NO: 14202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgatcccccctgactatgacgggctgtg

SEQ ID NO: 14203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgatcgcgagctcagtgcagcttccctc

SEQ ID NO: 14204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgcaccacgaactgacgatggccatggg

SEQ ID NO: 14205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgcaccatatatagctcgttctacatgc

SEQ ID NO: 14206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgccagctggtttcgcaaaatgtcgcga

SEQ ID NO: 14207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgccgccccacgggggagtgcacctggc

SEQ ID NO: 14208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgcctcctcaatgggatctaaaggtttc

SEQ ID NO: 14209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgcgaggttacgtgaaatggggggtttg

SEQ ID NO: 14210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgcgggttctacgttcctccgatgttag

SEQ ID NO: 14211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgctcaaactggagtgtagagctaggtc

SEQ ID NO: 14212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgctgacacatgatacgcacgatgagta

SEQ ID NO: 14213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggaattcaaagggtgttgttcggcggg

SEQ ID NO: 14214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggcacttgagtggctatcccgttattg

SEQ ID NO: 14215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggcataccggagtttagcgcatcaatg

SEQ ID NO: 14216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggcgcaatgtgtcctttcctgaggcct

SEQ ID NO: 14217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggcgcagcgactagtctcaacggccca

SEQ ID NO: 14218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggctagcataattgttcaacagcacgt

SEQ ID NO: 14219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgggaactcggaggcttgtcgtagcacg

SEQ ID NO: 14220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgggagagggaatagcggacgttggttg

SEQ ID NO: 14221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggtctgtaatgcgttggtatgacgcgc

SEQ ID NO: 14222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccggtggactatgcgttaggctgcatttc

SEQ ID NO: 14223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtaccatctaggtgacacgtgtgtatg

SEQ ID NO: 14224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtattctaatgcgactaatagttccaa

SEQ ID NO: 14225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtatttcacatatctatgcccctgcgt

SEQ ID NO: 14226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtcgcttgttatgtgtggcaggtccat

SEQ ID NO: 14227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtgatcttaccatcagtagtgaggctt

SEQ ID NO: 14228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtggaaatacactttggccgcttttat

SEQ ID NO: 14229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgtgtagccgtgtcagccgtcacgccgc

SEQ ID NO: 14230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccgttactatcaccgacggttccagcgcg

SEQ ID NO: 14231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctacccccgactgtccgcacctgttggg

SEQ ID NO: 14232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctattgttatgagcgatgctatcgtcgc

SEQ ID NO: 14233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctcgaacgatgatagcggacgtacggtc

SEQ ID NO: 14234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctcggcagctcttcacccactgtgattt

SEQ ID NO: 14235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctctaggcatcactactgtcatatgctt

SEQ ID NO: 14236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctctgtgaagtatttaccgattgcgtca

SEQ ID NO: 14237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgaagttcaagtggagctgggggcggg

SEQ ID NO: 14238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgactagcagttgactgcggtaggcgc

SEQ ID NO: 14239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgcgcgtattatcacgtatttgtgagg

SEQ ID NO: 14240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgcgtcgtaatacgcaaccgggacgct

SEQ ID NO: 14241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctggcgaatttcacggactggggtacgg

SEQ ID NO: 14242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgttagcaacaaacgcaatataaatca

SEQ ID NO: 14243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctgtttgtcgcggttcggggcacggtac

SEQ ID NO: 14244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccttacgactagccaggcctagccacgtc

SEQ ID NO: 14245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacccttcaaggcgattcatgacattcggccg

SEQ ID NO: 14246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccctttgatttaaatgtcccgttaccagct

SEQ ID NO: 14247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaaaagatgtacacaggtaccggcttag

SEQ ID NO: 14248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaaccgactcgtgatagggcatgtcgag

SEQ ID NO: 14249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaagcgctcaacgtgcgaagatcaagtg

SEQ ID NO: 14250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaatacgctggatgtttgccgactcatg

SEQ ID NO: 14251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgacctcagggatcctgtagctaatggac

SEQ ID NO: 14252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgacgccgccggatgcacaagggcaactc

SEQ ID NO: 14253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgacgttgctcactgtttcctcaagatga

SEQ ID NO: 14254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgactaatcttggatgggcggcagttgtg

SEQ ID NO: 14255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgactgatgtaagcctgtggtactcacgg

SEQ ID NO: 14256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgactgggtcaagccgctgggtttgttag

SEQ ID NO: 14257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgactgtcggatctgaatggaagggtgat

SEQ ID NO: 14258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgagcaatccaccctcgcgagatctatcc

SEQ ID NO: 14259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgagcaatgttcatacgtttgagtagtac

SEQ ID NO: 14260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgagcgccaggcggggtaagctcccttcg

SEQ ID NO: 14261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgagcgctaccaagcttcccgtgacgtcg

SEQ ID NO: 14262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaggagatttgtcactacttgtttacgg

SEQ ID NO: 14263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgaggcttacccatttgccttagttcgcg

SEQ ID NO: 14264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgagggttggtgagccgcctgtaaggcct

SEQ ID NO: 14265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgatagcggcaggttcatccagtattgcg

SEQ ID NO: 14266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgatcgcgacagtctaggtctacttattc

SEQ ID NO: 14267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgatggggcattggcggctaccgaatggt

SEQ ID NO: 14268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgatgtgggcgtatcagctcgacccgatc

SEQ ID NO: 14269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgattactctcgaatgttctcgttaatct

SEQ ID NO: 14270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgattagctttaaacctctctgcgtaacg

SEQ ID NO: 14271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgatttcctaagaccatctgcttggttac

SEQ ID NO: 14272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcaccggcgcggcaccgccagaatccca

SEQ ID NO: 14273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcacgctgcactattcttgactttccgg

SEQ ID NO: 14274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcacgcttaagctagtttacacggttag

SEQ ID NO: 14275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcacggacctgggcccaattggcacttc

SEQ ID NO: 14276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcactgcaattgctcccccagacacgca

SEQ ID NO: 14277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcagaatacgtggcacctggagatagcg

SEQ ID NO: 14278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcatacgttctcggctcttctcgtactg

SEQ ID NO: 14279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcatatggcaaagacaaataagcgtctg

SEQ ID NO: 14280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcccccgcatagtgctgccaatctacac

SEQ ID NO: 14281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcccgacggtcagcatgagggtcgtggg

SEQ ID NO: 14282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcccgcatcgtgaaagcacacatgcagt

SEQ ID NO: 14283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgccctagaagccgctggagttgcgctcg

SEQ ID NO: 14284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgccgtggtttgtcttgccctgccagggt

SEQ ID NO: 14285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcctcatgggtattcgtccggcatgtgt

SEQ ID NO: 14286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcctgcgttcctctggtgcgatgatgta

SEQ ID NO: 14287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgactttcggtatcttttcctggttaa

SEQ ID NO: 14288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgagtttcaggggctcgagcaaccaat

SEQ ID NO: 14289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgatcatagctagggacttgccacgcc

SEQ ID NO: 14290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgatgattctcagctgacgcagacatg

SEQ ID NO: 14291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgatgtctgcagccgcctaatctcttt

SEQ ID NO: 14292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgattgttacgtccgatttattctacc

SEQ ID NO: 14293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgcaactatcctgcaaagatcggcgac

SEQ ID NO: 14294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgcacggaattgctaggttggagtctc

SEQ ID NO: 14295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgcaggttcgccgtcggaaagccggga

SEQ ID NO: 14296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgcatagtccgaatgctggtaatagcc

SEQ ID NO: 14297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgcgttgacatggacgaaagcctggtt

SEQ ID NO: 14298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcggaacgatcggccttgggctacattg

SEQ ID NO: 14299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcggacatcgcccgcgtagctggctcgt

SEQ ID NO: 14300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcggcgatacaggttcccttctggctgc

SEQ ID NO: 14301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgtaggcaggtccgaccaaaacgtggc

SEQ ID NO: 14302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgtccgatctttcggcaaactcgtgct

SEQ ID NO: 14303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgtcggtattttcaggttgcccctggt

SEQ ID NO: 14304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcgttcagaggtagcttggttgtgtaaa

SEQ ID NO: 14305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctcgctgtgcgaacctctagccaccgt

SEQ ID NO: 14306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctcgtcacgcgcagctccttattcttc

SEQ ID NO: 14307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctcgtgggacttagcagagttgttggt

SEQ ID NO: 14308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctcttccggggggacatccttgtgttg

SEQ ID NO: 14309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctgcgatattctgacctctccgatttt

SEQ ID NO: 14310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgctggtgtgtgggcacgggcgaggggcg

SEQ ID NO: 14311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcttacggccccacctagtcggagccgg

SEQ ID NO: 14312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcttcatgcaatcaggcaagttctataa

SEQ ID NO: 14313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcttggatgtcatagcgcgatcacaagt

SEQ ID NO: 14314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgcttgggacggggattttacaggtctgg

SEQ ID NO: 14315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggaagggcgttgtccttttttgacgtgc

SEQ ID NO: 14316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggaagtgaccacatactccttcggccgg

SEQ ID NO: 14317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggacaaactcttcgacagctttttcgag

SEQ ID NO: 14318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggacacggctagaacagtagccaaggct

SEQ ID NO: 14319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggaccatagccagaggcgagccttttct

SEQ ID NO: 14320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggactttcggtttacagtttcgtcaatg

SEQ ID NO: 14321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggagaaccgtgctacaaaagcgatgctg

SEQ ID NO: 14322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggagggataccgtgccgtacggcctggc

SEQ ID NO: 14323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggatccatcacttggcatgacttgttga

SEQ ID NO: 14324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggatgcatttccaatcgactggggattt

SEQ ID NO: 14325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggattcaccactggagggttagtttggc

SEQ ID NO: 14326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcaacgtagtcgcaatagagcactcgc

SEQ ID NO: 14327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcaatgcaccgaccagcggaaggctcg

SEQ ID NO: 14328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcaccccctcttgttcgcgccacctcc

SEQ ID NO: 14329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcagcctttgtggtccagcttgatgcc

SEQ ID NO: 14330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcagcgtactagttgaaaatgcgcgcg

SEQ ID NO: 14331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcaggggatataacggccatcaattgc

SEQ ID NO: 14332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggccaccatatttaatcgcgccgcgacc

SEQ ID NO: 14333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggccatggccaactcataggtgctgggg

SEQ ID NO: 14334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggccgtgttatcgctttaataagctcaa

SEQ ID NO: 14335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcctgtcaatcagtgagaccggaactg

SEQ ID NO: 14336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcctgtgatttcgggtcgcttagcctc

SEQ ID NO: 14337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcgattcactcccgattattacatcgt

SEQ ID NO: 14338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcggaataacatggtaaggctggcgac

SEQ ID NO: 14339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggcggatgggattggggtcgctcgtgtg

SEQ ID NO: 14340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggctggggtgtatggcgttactcggtat

SEQ ID NO: 14341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgggacgagtgagtctcagataaacgctt

SEQ ID NO: 14342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgggcaccacgcgtaatctctggttcgtg

SEQ ID NO: 14343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgggcactgtaaatcggtcccaggctcga

SEQ ID NO: 14344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgggcagtttgttaggcttacgtggggtc

SEQ ID NO: 14345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgggcatcatttttccatagagttgatag

SEQ ID NO: 14346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggggtggactcttacaggaaaggtggat

SEQ ID NO: 14347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggggttatattgtcccgtgtcgcgggtg

SEQ ID NO: 14348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtaccgctgcgggaggattaataagcg

SEQ ID NO: 14349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtactgcactaatcaacaaacgtcggc

SEQ ID NO: 14350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtccgaacaacgttaattgggattgat

SEQ ID NO: 14351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtggcgggagaaggcaaagtcaatggg

SEQ ID NO: 14352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtgttcccgccgcagtgtagacggcct

SEQ ID NO: 14353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccggtttaagtgtgaagacgacagtagagg

SEQ ID NO: 14354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtaaacctcgtagtcttctgccgggttc

SEQ ID NO: 14355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtaatggctcgagcgggcgcaattcgat

SEQ ID NO: 14356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtacgttgtcgacgtcagactcgtgtcc

SEQ ID NO: 14357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtactccttgccacgtctcccaccagcg

SEQ ID NO: 14358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtagagccaagtcggaccgcattgggca

SEQ ID NO: 14359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtatcagcatgcggtggttcggtggatt

SEQ ID NO: 14360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcaaaacgcgcaagtcatacagtcaga

SEQ ID NO: 14361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcactcgtccgttgctgcgttgctgtc

SEQ ID NO: 14362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcagatagagatggcactctgcggcct

SEQ ID NO: 14363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcagcagaccctcgtagtgatgggcgg

SEQ ID NO: 14364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcaggagatagcaaggtattccggtgg

SEQ ID NO: 14365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcatcacagacattttagttctttgtc

SEQ ID NO: 14366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcgacgatctatgcccaaaatgcgtgg

SEQ ID NO: 14367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcgtcgtgcgtaaaccggtgtggaaga

SEQ ID NO: 14368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtcgtctaccctggaagcagaattggcg

SEQ ID NO: 14369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtctataacccgttggattggtcaacca

SEQ ID NO: 14370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtctggccttacttctgaaccttgcttg

SEQ ID NO: 14371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgacatctctatgcaaagatgtaaacc

SEQ ID NO: 14372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgactgggtacggttcggcacataccg

SEQ ID NO: 14373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgccgaagtcgcagtgggctgcccgat

SEQ ID NO: 14374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgcgtttcccaaactctgcctgtcttt

SEQ ID NO: 14375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgctgtgaacgcttctcctaagtcgtc

SEQ ID NO: 14376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtggatctgctcgtacctccgaccgtta

SEQ ID NO: 14377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtggattattttgttcgcgggcaggggt

SEQ ID NO: 14378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgggctctcgtcatgtctacaagttaa

SEQ ID NO: 14379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtgggttacgacacgcaccgtcgctctg

SEQ ID NO: 14380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgttccagtcgatgtcgaaatccggtaga

SEQ ID NO: 14381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgttccatggagcaaaccctcaccctagt

SEQ ID NO: 14382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtttaccccacatccgcacgtttgtcct

SEQ ID NO: 14383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccgtttatgcgtagcgtaccccaagcggtt

SEQ ID NO: 14384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaaaagtatgagtttcttgatatgaggt

SEQ ID NO: 14385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaacccgcgccacccctagtatacagtc

SEQ ID NO: 14386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaaccgaccgggtgcgtgcaatccggag

SEQ ID NO: 14387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaaccggccaatccgcgcatacccgggc

SEQ ID NO: 14388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaagagagaacggtgaactggaagaggc

SEQ ID NO: 14389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaagcaaacaggtgatccccgtggggag

SEQ ID NO: 14390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaatccggggacccatgaacttgttgct

SEQ ID NO: 14391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctacgttcgctgcagcggtccacagctta

SEQ ID NO: 14392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctagcagccactcgtccatacactaggtt

SEQ ID NO: 14393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctagccgtatttaccgccggaacaattgg

SEQ ID NO: 14394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctaggttgcgtcacgtcacccctggaaac

SEQ ID NO: 14395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctagtagagcaatcccggaacatgggtta

SEQ ID NO: 14396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctagtattcgagcatcaggttgcgacttc

SEQ ID NO: 14397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctataacaatttttctggattcagcgggt

SEQ ID NO: 14398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctatccgcgtggtcgcaatccgtagttgg

SEQ ID NO: 14399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctattctcgccgtttggatgtcgtgtctg

SEQ ID NO: 14400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcacgagtatcggtcagtccaggagctt

SEQ ID NO: 14401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcagaacggggtcgtcatgtctgcggca

SEQ ID NO: 14402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcagcacaagtatcctccaaccgacctt

SEQ ID NO: 14403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcaggaataacgacaagccagactgtgt

SEQ ID NO: 14404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcatcccaacagtcacgcttgctgccct

SEQ ID NO: 14405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccacttttctaggcatcaaacctgtgc

SEQ ID NO: 14406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccaggattgagacactgccagcagggc

SEQ ID NO: 14407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccagtactagagcaagcggtccatctc

SEQ ID NO: 14408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccataatgtcttatcccttatgcgtga

SEQ ID NO: 14409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccatgcggatagtttaaccgtattgtc

SEQ ID NO: 14410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccccgcaccagttatcgttcatcggtc

SEQ ID NO: 14411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccccttagcgttttcatctaaatgtgc

SEQ ID NO: 14412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctccgaacttgtgtgcttttgacctgatg

SEQ ID NO: 14413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgatcggttgacttcttgcgaatcggt

SEQ ID NO: 14414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgcactcggcagccttatttgcggctc

SEQ ID NO: 14415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgcagcgttaacggaaagcgtgatgtc

SEQ ID NO: 14416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgccgcacatccgataatcccctgcgc

SEQ ID NO: 14417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgcgtagtctctccaggcagcatgtac

SEQ ID NO: 14418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgcgtctctgcctgagtgattataggt

SEQ ID NO: 14419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcggctagcgtcccactcttggcgtgta

SEQ ID NO: 14420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcgggacagggcacctggatcaactaca

SEQ ID NO: 14421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctaaacggcgatcggattccggcaaag

SEQ ID NO: 14422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctccattcgtgtggttcctgaggcgca

SEQ ID NO: 14423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctccttattgctccgtgtatgagggga

SEQ ID NO: 14424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctcgaaagcgaataagtcccgacagtc

SEQ ID NO: 14425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctcgaaataggtattcagaaggccatg

SEQ ID NO: 14426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctcgttgttgtgcacaggttgggtttg

SEQ ID NO: 14427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctctactgcgatctccttttaacggtt

SEQ ID NO: 14428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctctcgagtacatggtaaaggcctttg

SEQ ID NO: 14429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctcttgtcgatggcggcagtgctacgc

SEQ ID NO: 14430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctctgacttgttagcgtgtttacactgtg

SEQ ID NO: 14431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcttaatcaaagacatcatctgttctag

SEQ ID NO: 14432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctcttcactttatctggcagttctgtcgg

SEQ ID NO: 14433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgacccgcggataattgttgttggtttc

SEQ ID NO: 14434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgagagtggcaggtgtgtggactttgag

SEQ ID NO: 14435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgaggctaaattgcgagactaagttcgc

SEQ ID NO: 14436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgatcccacgtcctctaatcacttgtgt

SEQ ID NO: 14437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcaaaatcccgtcaagtatggggctta

SEQ ID NO: 14438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcaatgttcgatatatttctaccgcga

SEQ ID NO: 14439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcacgcattctcctagattcttcgaat

SEQ ID NO: 14440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcacggaagttttatcattaatttggc

SEQ ID NO: 14441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcattgggtcaattcttacttgattgg

SEQ ID NO: 14442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcgcaaacctcatactaacgtgtagtg

SEQ ID NO: 14443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcgccttttaggctagtgttttttagt

SEQ ID NO: 14444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcgctccagaacgggtgatttagacga

SEQ ID NO: 14445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcggatgagaggtaaccgttgtaggcg

SEQ ID NO: 14446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgcgggtgtgtctagcttttttccgctt

SEQ ID NO: 14447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgctgtactgcgccacgtgcctcggtcg

SEQ ID NO: 14448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgctttacatgcctttccggagccacaa

SEQ ID NO: 14449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggatcgtgtagcacatctcggagtggc

SEQ ID NO: 14450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggcacgaagtatcttggtcgatgttat

SEQ ID NO: 14451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggccatgaccacttcggtttatgaggc

SEQ ID NO: 14452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggcgaatggcgggttaagtccgttgac

SEQ ID NO: 14453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgggctcccgtgatttatgcatcccgat

SEQ ID NO: 14454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggtagacgactggagtaatgtaccgtc

SEQ ID NO: 14455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctggtcggatgagtccaaaagccgcgtgg

SEQ ID NO: 14456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgtcaagatactagctctcctattcagc

SEQ ID NO: 14457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgtcctctgcatgattacggcttcggtg

SEQ ID NO: 14458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgtgaccagcgcgcagtctcgtgttcgg

SEQ ID NO: 14459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgtgttcaacaccttgaaccgctatgca

SEQ ID NO: 14460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgttcacggccacgggatcatgtggtcg

SEQ ID NO: 14461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctgttcgtcccggaggttatgcgcgattt

SEQ ID NO: 14462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttaaactggatcccgcacgcctcactaa

SEQ ID NO: 14463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttaagactccaacactttcctcttggcc

SEQ ID NO: 14464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttatctctgctcgttttttgcagcctag

SEQ ID NO: 14465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttatgtgcaggtatctataagttcacat

SEQ ID NO: 14466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttattggcgaacaatcttacgcgagttt

SEQ ID NO: 14467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttcagaatctcgtgatccgtgacagcgg

SEQ ID NO: 14468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttcagctaacgagcccctttttacaccg

SEQ ID NO: 14469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttcatccgtcaaacctttatgtgtgctg

SEQ ID NO: 14470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttccggatttggagcgatcgatatgcac

SEQ ID NO: 14471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttccgttcgggagacatacacgtggaag

SEQ ID NO: 14472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttctgagtccggctcgcgggttgagggc

SEQ ID NO: 14473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttctgtcggaatgatgggtcctggtagc

SEQ ID NO: 14474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgactcgagggtgaaaatgcggcggtg

SEQ ID NO: 14475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgagcccagcttcagcgtatcggcgtg

SEQ ID NO: 14476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgagctgactgggctaggggtaaagcg

SEQ ID NO: 14477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgcacttacctcccttactgcctaccc

SEQ ID NO: 14478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgcgcataggtctccttcacgccaatc

SEQ ID NO: 14479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgcgtagggtatatacctgatgcgcgc

SEQ ID NO: 14480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgctccatcgttccgcactttgagggt

SEQ ID NO: 14481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgctctggctacactcagacacactgc

SEQ ID NO: 14482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgcttagtggaatcaaccgggggttcg

SEQ ID NO: 14483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttgtccttctctagttcgtaaatcccgg

SEQ ID NO: 14484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctttaaagagtgactaaacgggctgctcg

SEQ ID NO: 14485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctttatgatagtgagggctcgtcctagga

SEQ ID NO: 14486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctttggccacctcgccgacacttctcctc

SEQ ID NO: 14487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacctttggggcgcagtactgtccaggccgcg

SEQ ID NO: 14488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caccttttcccgacgatcggaactccacggcc

SEQ ID NO: 14489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaaaaccggtcaaactgctgtatgataa

SEQ ID NO: 14490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaacgggtgggggagtgttgctttacga

SEQ ID NO: 14491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaaggcactttgtctaagaagattcctg

SEQ ID NO: 14492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaaggcaggggtctctgcgctcggtgga

SEQ ID NO: 14493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacacgtatacggcggcgcgttcccgct

SEQ ID NO: 14494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacagccatgttcccacagtagcttctc

SEQ ID NO: 14495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacattggttaaggtactatctcgatgg

SEQ ID NO: 14496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaccaagtgtgacaggagggcctgtgcg

SEQ ID NO: 14497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaaccactcctgtgacgtgttttctccgg

SEQ ID NO: 14498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacctatatcgactaagtttgagaactt

SEQ ID NO: 14499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacggcctctacggtgataacccgtccg

SEQ ID NO: 14500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaacgtgtcccaaacgccggtcccgagcc

SEQ ID NO: 14501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagagctaggcctgtttccgatgcgcgg

SEQ ID NO: 14502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagagtaaatgccgagatggcgccgggg

SEQ ID NO: 14503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagctgcgtaactcgcgtagggatcggc

SEQ ID NO: 14504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagcttcgtcgtatttctttgagtttac

SEQ ID NO: 14505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagggagtcaacgggattctggctcagt

SEQ ID NO: 14506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagggcggtaccgccatatgttcgtgtt

SEQ ID NO: 14507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagtggcccatacgcctccccgctacgc

SEQ ID NO: 14508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaagtttggacatggcgctgtgtgacgga

SEQ ID NO: 14509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatcgccctgaggtgatcatgtttgcgc

SEQ ID NO: 14510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatgcagatctgggagtggggtttcatc

SEQ ID NO: 14511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatgctgcgggatgtggtgtctcggtta

SEQ ID NO: 14512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatggccgtcgcatcccggatcgctctg

SEQ ID NO: 14513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatgtcaaggaccgttctcttttccctc

SEQ ID NO: 14514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaattaccactttctaaccctgttgctcg

SEQ ID NO: 14515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaattggtttcgttaatgtttgctcctta

SEQ ID NO: 14516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaatttcaccagttgttcattcactccga

SEQ ID NO: 14517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacaacatagctgcgaattagagttcagc

SEQ ID NO: 14518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacaaccccgttctgccctgtcatactct

SEQ ID NO: 14519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacaatatccactctgggtccgctacgga

SEQ ID NO: 14520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacacacaccgagtcattcgtccaccctt

SEQ ID NO: 14521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacacccgacggatacaggttttggcgcg

SEQ ID NO: 14522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacaccgctcgttcgtgacggggagcgta

SEQ ID NO: 14523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacacgtacgtcccaggctcagccggatt

SEQ ID NO: 14524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacagtgttacgagtgaagatcaggctcg

SEQ ID NO: 14525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacatacgctaagggaacagtgcagggcg

SEQ ID NO: 14526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacatggtatatcgcatatcgttagcaca

SEQ ID NO: 14527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacattcttggcctattccataaaggtgc

SEQ ID NO: 14528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccacgtcagatagcttggggtggagga

SEQ ID NO: 14529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccacgttggagagagtccgagggtatt

SEQ ID NO: 14530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccagccgtctgtgggtcatctttgtat

SEQ ID NO: 14531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacccattggcataacgacttgcggcatt

SEQ ID NO: 14532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccctattggatgtgttcggccattttc

SEQ ID NO: 14533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccctgcacaccactgatccatcctcgg

SEQ ID NO: 14534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccgactttgcaatttttgaccgacgcc

SEQ ID NO: 14535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccgatgaggcttggactccgcatgcga

SEQ ID NO: 14536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccgcaatcgggaacttcctgtgtggtg

SEQ ID NO: 14537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaccgccttgcctctacgacatcagagct

SEQ ID NO: 14538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacctagcgccgcgaagcgatcgattctg

SEQ ID NO: 14539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacctgggcatcagtgttagttagccggc

SEQ ID NO: 14540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgacgtcctcacgttagagtccagctc

SEQ ID NO: 14541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgcacaggattatggatctcatttgct

SEQ ID NO: 14542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgcagacgcttcaggctaccctggatt

SEQ ID NO: 14543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgctcatggttgttgaatggggttcta

SEQ ID NO: 14544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacggcagtggcaacattttccctttcgg

SEQ ID NO: 14545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacggctttgcctgacgaggtggttgacg

SEQ ID NO: 14546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgggcgtttccttgctatggcacctcc

SEQ ID NO: 14547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgggctcggcctcagcgatggtgcggg

SEQ ID NO: 14548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgggtggctcctggttgcgcgtacggg

SEQ ID NO: 14549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgtcacgatacgcaaggatcaacaggg

SEQ ID NO: 14550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgtgatcttatgtacgctctcttcgcc

SEQ ID NO: 14551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgttaagcagcgaatagtaacatggtc

SEQ ID NO: 14552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgtttgtgtgggattcgtagcctgctc

SEQ ID NO: 14553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacgtttgttcgtttggcatgatggttgg

SEQ ID NO: 14554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactagctctctacatgtctgttatgcgt

SEQ ID NO: 14555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactatgattcgcaaaaccggggacgagg

SEQ ID NO: 14556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactcacagtgcaaacgtacgcggagtcg

SEQ ID NO: 14557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactcacttctccacggctctttcatctc

SEQ ID NO: 14558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactgcggtgtcttcaagcagagaagcgt

SEQ ID NO: 14559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgactgtcgcaaaaggatctgtcccgttca

SEQ ID NO: 14560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgacttagcaaatccgtcctccttggcttg

SEQ ID NO: 14561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagaaaagcctttcacatcgggcagcaag

SEQ ID NO: 14562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagaccactctgcacgcatgccaatcaag

SEQ ID NO: 14563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagaccctggttcattactggtgcgcgtg

SEQ ID NO: 14564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagaccgcgtttttattaagaataatatc

SEQ ID NO: 14565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagacgttacttagctacttgcggctttg

SEQ ID NO: 14566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagagacccagggagacattcgcgcgcga

SEQ ID NO: 14567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcagtccggcgtcagtgtgcgagtaca

SEQ ID NO: 14568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcattaggcgaaccgagttacttcgag

SEQ ID NO: 14569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcctgtatgtctccttgtgtggggttc

SEQ ID NO: 14570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcgcgcatttacctttgatgcacacac

SEQ ID NO: 14571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcggagacagtcctcctacatgcgttt

SEQ ID NO: 14572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcggcccgcaagatctgtggttagaaa

SEQ ID NO: 14573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcgggggtccatgcgatgactcttgct

SEQ ID NO: 14574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcggtgcacaagggacgttctcgcccg

SEQ ID NO: 14575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcgtgcaatcgggcagacgcatgcggg

SEQ ID NO: 14576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagctacgaggtatttgctacccgaaacc

SEQ ID NO: 14577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagctcggtgacagtggtcgagggtggct

SEQ ID NO: 14578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagcttccgttacgatactcccagacggc

SEQ ID NO: 14579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggaggccacaagcgcctttggtttggg

SEQ ID NO: 14580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggatctgctatgttagtgttcccagtc

SEQ ID NO: 14581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggcaatggtgacagagcccaacgcttg

SEQ ID NO: 14582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggcgttcgttcgtttctggagaccatg

SEQ ID NO: 14583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggctgtaatgggatagatagccggatc

SEQ ID NO: 14584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagggacatctttgcgacacggtacgtcg

SEQ ID NO: 14585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagggagggacggctgcttttagtatcgt

SEQ ID NO: 14586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagggcactagaccgcatggatctcgcta

SEQ ID NO: 14587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggggtatgcttcgtttcatgcggaata

SEQ ID NO: 14588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggtgtcgcgagttgtgcgggcattgtg

SEQ ID NO: 14589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgaggttaagtgctgtgctggcatacgggt

SEQ ID NO: 14590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagtgccgctgaccatacctcagatatga

SEQ ID NO: 14591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagttagactcgggcattccggacacagg

SEQ ID NO: 14592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagttcactagtatcaatagctcttttcg

SEQ ID NO: 14593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagtttcaaaacctcccgtatgatcttgc

SEQ ID NO: 14594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgagtttgcggagatgggaaatccgcttct

SEQ ID NO: 14595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgataacaattggactcgtttgttatgtta

SEQ ID NO: 14596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgataacacgcgacgtttgcgcaggccgaa

SEQ ID NO: 14597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatacgtcggtacgccaagtgtcacggcg

SEQ ID NO: 14598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatagcggcttagccaggcagtctacatg

SEQ ID NO: 14599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcaagctactacagattttgtattcgg

SEQ ID NO: 14600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcaatggggtcaaattcggtggtttgg

SEQ ID NO: 14601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcaatgtcttcattacatgacgaatgt

SEQ ID NO: 14602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcaatttaagtcggggtggggcgtggc

SEQ ID NO: 14603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcacttgcctcactctgagtagggctg

SEQ ID NO: 14604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcaggtttagaagaccacccgctgagc

SEQ ID NO: 14605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatccaactacaatccacggaacttatgt

SEQ ID NO: 14606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatccatgagcttcactctgcggcttcgg

SEQ ID NO: 14607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcgatacagcagagcagaacgtgaaac

SEQ ID NO: 14608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatcggctagctagtcctcagctcgggcc

SEQ ID NO: 14609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatctcacacagtggcacgaatatgttta

SEQ ID NO: 14610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatctcagcccggtcgtacacaaatggcg

SEQ ID NO: 14611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgatagtcgccgttggccgtacactgc

SEQ ID NO: 14612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgccttaaagctgtcctcatgcgcgtt

SEQ ID NO: 14613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgcggctgctcgaaagtccggtccttt

SEQ ID NO: 14614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgcgtttgcagccgaccctagttgacg

SEQ ID NO: 14615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgcttccaccgcaacatggatgcgggt

SEQ ID NO: 14616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatggatgcgttgagaccagcgtcgtgta

SEQ ID NO: 14617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatggtggacggtttcggtattctttgtc

SEQ ID NO: 14618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgtaggttttaaaaaaccatgtgggcg

SEQ ID NO: 14619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgtcttgtacttccgaccggtccgtgc

SEQ ID NO: 14620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatgttatcggccgccgccatgcgttcca

SEQ ID NO: 14621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgattaggccgaaactagtgctgtttgcgc

SEQ ID NO: 14622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgattcatacggagattcctgcagcgggta

SEQ ID NO: 14623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgattctggctgacgtgtcaagctgaggta

SEQ ID NO: 14624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatttcaacctgcccactccagtgtcgag

SEQ ID NO: 14625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgatttgttgcgcagttgtaccgcatgacc

SEQ ID NO: 14626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaaacgctggaatacgctttgaggtaat

SEQ ID NO: 14627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaaccccctgaaccttaaattgggttaa

SEQ ID NO: 14628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaagccagcgtatttgcacgaaccgttc

SEQ ID NO: 14629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaagcccaaagtgtattgcagaggtggt

SEQ ID NO: 14630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaatcacaccctaacttccgcgcaacac

SEQ ID NO: 14631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacaagccttttaccctagatgcccatg

SEQ ID NO: 14632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacactcgcctgtattcgcagctgcctt

SEQ ID NO: 14633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacactcggaattcgatgaactctctgt

SEQ ID NO: 14634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacatatggccggccgtagttgtagtgc

SEQ ID NO: 14635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaccggggtcatggtacgaccaactggg

SEQ ID NO: 14636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacgagccgccaaatgcattgcgggccc

SEQ ID NO: 14637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacgagtggctagtgatgtgttgacctg

SEQ ID NO: 14638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacgctcatcggtacttcgttctagctg

SEQ ID NO: 14639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacggtatgagacccgcagtgactgttc

SEQ ID NO: 14640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacgtggcttgttttgcgggtggtaatg

SEQ ID NO: 14641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcacttcgagggacgcgtctctcctcgcg

SEQ ID NO: 14642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcactttaggtctgactcagcggggttga

SEQ ID NO: 14643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcactttagttgacttgatatagttggta

SEQ ID NO: 14644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcactttcaacgtccggtggggtgcactt

SEQ ID NO: 14645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagaaagtacatacgattttgttgttac

SEQ ID NO: 14646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagaccaggttctgagctccggctcgcg

SEQ ID NO: 14647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagagcttaataggggtggggctacgtt

SEQ ID NO: 14648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagagtccgcctgtgactggttattatg

SEQ ID NO: 14649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagcaccgttcgaggattgctagcgggt

SEQ ID NO: 14650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagcactctggactaacgttcgatctcg

SEQ ID NO: 14651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagcagggatcgcggtgcactcttcacg

SEQ ID NO: 14652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagcatacttcagattgggttcgtgtac

SEQ ID NO: 14653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagcgggaatgttgagaaggcatgagac

SEQ ID NO: 14654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagctgtaagaccttcatccccaacaac

SEQ ID NO: 14655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaggatcagttccccgttgcctggtgat

SEQ ID NO: 14656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcaggctttacgaggtcgttttagcgcga

SEQ ID NO: 14657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagggccggacgttgcatcacgcgccgc

SEQ ID NO: 14658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagggctagcctccgaagatgccgaccc

SEQ ID NO: 14659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagtactattctttgatgtattttgggg

SEQ ID NO: 14660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcagtttttacgggtattagatccgtggc

SEQ ID NO: 14661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcatacaaccaggtcgagggaaacgcgcc

SEQ ID NO: 14662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcataccgaacggggagtaagacatgggc

SEQ ID NO: 14663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcatcgctgaaaacatctacccgcttaat

SEQ ID NO: 14664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcatcgttcacggcacggcgcgggtcatc

SEQ ID NO: 14665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcattgattgtaactgtggactagcggta

SEQ ID NO: 14666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccaacacgtaggagatcacggactttcc

SEQ ID NO: 14667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccaagtttgatgtgcgtgcattcgcctc

SEQ ID NO: 14668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccacaacatattaccctgtttaactcga

SEQ ID NO: 14669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccaccagacagtgtgtaggtttcttgcg

SEQ ID NO: 14670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccacctggtacaatgccgggggtccggt

SEQ ID NO: 14671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccacctttagtgaacctacggttcatgc

SEQ ID NO: 14672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccactcccggttcagcaacatttggccc

SEQ ID NO: 14673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccagcacgggcgcctgtccacagcccaa

SEQ ID NO: 14674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccatgaggattctgctgtgtccaccgtg

SEQ ID NO: 14675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccatgttttaccgattgctactccatgg

SEQ ID NO: 14676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcccaaaatttgagtggccctgtgtgcaa

SEQ ID NO: 14677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcccactgggtggttgggatatccgggac

SEQ ID NO: 14678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccccgacccttgttagccaggcgcgacg

SEQ ID NO: 14679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccccgacgctctggtttcgtccctgtgt

SEQ ID NO: 14680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccccttcgcgagtgtatcgcccgacagt

SEQ ID NO: 14681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcccgcactgtggttccccggtgtgtacg

SEQ ID NO: 14682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcccttagtccagttgtgcagccaggcca

SEQ ID NO: 14683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccgaacccctaagtgacagatccgaatg

SEQ ID NO: 14684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccgaatacctctcgtccggaccaaggtg

SEQ ID NO: 14685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccggcgctgctggcattcggtaggcgat

SEQ ID NO: 14686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccgttggtcccccttgaattcggcgaac

SEQ ID NO: 14687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctaacttcccttggacactccctactg

SEQ ID NO: 14688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctaaggtagttcaatcgtgtgctcatc

SEQ ID NO: 14689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctcaggggggagtccacgagatggagc

SEQ ID NO: 14690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctcgaggtttagatccaagtacccccg

SEQ ID NO: 14691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctcgcgttgatgtcaatggccgatttt

SEQ ID NO: 14692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctcttgtctaaaaacgatcaggttgcg

SEQ ID NO: 14693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcctgctgtggacacttcggttgtcactg

SEQ ID NO: 14694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccttctgcgccgacatgctccctactat

SEQ ID NO: 14695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccttgtccgagttgactgccctgtctgg

SEQ ID NO: 14696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgccttgtcttagccggctggactggagtg

SEQ ID NO: 14697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgaacggaattgtgggcacggcttgccg

SEQ ID NO: 14698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgactgtagcacgatgaacgcgggttgg

SEQ ID NO: 14699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgagcagggtccgagtttacatgtgatt

SEQ ID NO: 14700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgaggctggaacggtagcggacttagcg

SEQ ID NO: 14701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgatatagatttgaagggattggtaggt

SEQ ID NO: 14702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcaagctgttcagtgctgtgagttgtg

SEQ ID NO: 14703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcacgactcgcgatcttgtgtttctct

SEQ ID NO: 14704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcatagcgtttcattcggcaaaagagg

SEQ ID NO: 14705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgccaggcttaacagcgggaccaacaaa

SEQ ID NO: 14706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgccattcactgaaccccgggccttttg

SEQ ID NO: 14707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgccctatcgcacctgcaccatcatacc

SEQ ID NO: 14708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgccgccaagcatagtcggaggctccga

SEQ ID NO: 14709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgccgccatactctcgagacgggccgtc

SEQ ID NO: 14710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcgagtacgggttgtgtgtgagcaggc

SEQ ID NO: 14711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcgctacttccgagacatggcgatcgc

SEQ ID NO: 14712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcggatgtaagcactatccttagatac

SEQ ID NO: 14713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcggcacccgcgaccgtgaatgaggta

SEQ ID NO: 14714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcggggattctgcgctctcgggtacgt

SEQ ID NO: 14715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcggtgactgggtttgtcggcttcccg

SEQ ID NO: 14716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcggtgcgaggtaaggggcatatgctg

SEQ ID NO: 14717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcgtcgacgtttcttgtccccggagtc

SEQ ID NO: 14718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgcgtcgagtttggcatttggttgagtt

SEQ ID NO: 14719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgctgtccctcagcaaactcgacagatt

SEQ ID NO: 14720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggcacctgcgatactgaacctcgaagg

SEQ ID NO: 14721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggccggtgggcggacacgtacgtcgcg

SEQ ID NO: 14722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggcgaacgaagtccggatcggttttcc

SEQ ID NO: 14723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggctagttgaagggttgtgttgatgcg

SEQ ID NO: 14724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgggagagtatgggccctgggctcgggg

SEQ ID NO: 14725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgggagctctagacattctgggcaggcc

SEQ ID NO: 14726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgggagctctggtcattctcctggttat

SEQ ID NO: 14727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgggataagggttagttcccttcaccgg

SEQ ID NO: 14728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggggataatggcgtcggaatcaggggt

SEQ ID NO: 14729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggggatagtgtcacgaaagcgcctctg

SEQ ID NO: 14730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggtcgagctgtccctttccagcccccg

SEQ ID NO: 14731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggtcgtaatggtcattccggaggccac

SEQ ID NO: 14732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggtctaggtatttggaggagtggcatg

SEQ ID NO: 14733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcggtttcgcaggttggctccgacgctag

SEQ ID NO: 14734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgtagcctctgccgactaacggtacatc

SEQ ID NO: 14735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgtcaatagtaaaaggcatttatttagg

SEQ ID NO: 14736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgtccatccccgccgggtttgccggttt

SEQ ID NO: 14737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgtcctcatccaggtatcaaacaaagtg

SEQ ID NO: 14738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgtgcgacctgcgatctttcttgtgtgg

SEQ ID NO: 14739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgttacggcgatttattacggtttcgta

SEQ ID NO: 14740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgttagttttcaaacttttacaagaata

SEQ ID NO: 14741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgttcaattggtgtacgtatacgccgct

SEQ ID NO: 14742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgttcagttgacggtcacaacgtttgtc

SEQ ID NO: 14743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcgttctttcctcaatccacgttgtccgc

SEQ ID NO: 14744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctaaaaggtatcgatatgatatcccgga

SEQ ID NO: 14745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctaaaatctcgatgcgatatgcacgatc

SEQ ID NO: 14746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctaaggtcacagctattcccgctgtggc

SEQ ID NO: 14747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctaataacacaactcccttagccgcacg

SEQ ID NO: 14748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctacattatgggtttgtagtagttactt

SEQ ID NO: 14749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctaccgtaccggcttgtcaaggtgggtg

SEQ ID NO: 14750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctacggggccgcaatagtcgctgactgg

SEQ ID NO: 14751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctagaatgattcggtaccggctttgtct

SEQ ID NO: 14752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctagttgcgggatcaccaggcgtgttgc

SEQ ID NO: 14753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctatcgttttgcaacattttattgggat

SEQ ID NO: 14754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctcaaggtttgctcaacggaatacatta

SEQ ID NO: 14755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctcacgccattgctcgtcagcctgtgct

SEQ ID NO: 14756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctccggaacacctatagccgacgcatcg

SEQ ID NO: 14757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctcgcctcgagatagatgcgtgttgacg

SEQ ID NO: 14758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctcgggagtggttgtccaccttccgtcc

SEQ ID NO: 14759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctcttcacgaataggttttacgtggccc

SEQ ID NO: 14760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctgaatcatgtgctcggcggacagcggt

SEQ ID NO: 14761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctgagcatcagaaagcccggagtcgata

SEQ ID NO: 14762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctgcccttgaatttgccgcttctaggtg

SEQ ID NO: 14763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctggcatgactttacacactgtccaacc

SEQ ID NO: 14764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctggcggttcataccctgactgtcgcgg

SEQ ID NO: 14765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctggtcagttaccttctgcgctcagtcc

SEQ ID NO: 14766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctggttttcgcgagggggtagtggttgg

SEQ ID NO: 14767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctgtgttctgttctacagtcgatgtgca

SEQ ID NO: 14768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctgttatttcacatgcactgacgtctgc

SEQ ID NO: 14769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttacatggcggacactctgagttgcta

SEQ ID NO: 14770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttacggacgtttgatacgaggggacgt

SEQ ID NO: 14771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttatcatcaaatcttcaaggggtgtag

SEQ ID NO: 14772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttatctacatcccaaggggggcactgg

SEQ ID NO: 14773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttcccatggctgggacatttcctcaac

SEQ ID NO: 14774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttcccggcttggaattgcggcccttgc

SEQ ID NO: 14775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttccgcccgtccattgcttttcgcgac

SEQ ID NO: 14776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttctaccgcagccttagtcccgtcccc

SEQ ID NO: 14777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttgagccgttacgctgatacgtctccg

SEQ ID NO: 14778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttgattcattccgtatttgacagccct

SEQ ID NO: 14779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttgtaccttggatccctaaattcaata

SEQ ID NO: 14780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctttcaggctattgttactcacgtcggc

SEQ ID NO: 14781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctttctcttgatcattgctcttgtcagg

SEQ ID NO: 14782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgctttgtagttgtattacccaggttcctc

SEQ ID NO: 14783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgcttttcggattgatgtcgttgtgcgggg

SEQ ID NO: 14784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaaactttccggtgaatgatctgtgcgg

SEQ ID NO: 14785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaaatattttaactgaggcctcatctgg

SEQ ID NO: 14786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaacggcagtggattgcaatggatcgac

SEQ ID NO: 14787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaactagggactgcccgcgagcgatggc

SEQ ID NO: 14788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaagagcgctgacaaaccgttcctcggc

SEQ ID NO: 14789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaagcattatcctcgtcgcatttaagtg

SEQ ID NO: 14790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaattacccgtttgaggttctgcgcacg

SEQ ID NO: 14791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacaacgcaacggaatcacacgtaggtc

SEQ ID NO: 14792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacaagtttacggcacgaacactacgcc

SEQ ID NO: 14793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacaatccccaggttttgtctcgttcgc

SEQ ID NO: 14794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacaccatgcttctcgcgctgtaggacg

SEQ ID NO: 14795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacatcctagtgagtaacgtgtgccggg

SEQ ID NO: 14796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaccaacacgcgacaggcatggatactt

SEQ ID NO: 14797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaccactttgatagcccctttttcgcga

SEQ ID NO: 14798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaccctttattacacagtgattcgaatc

SEQ ID NO: 14799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacctcttctgtcggtgtatctgagcgg

SEQ ID NO: 14800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacgcatcgggtatcacgctttaggcct

SEQ ID NO: 14801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacgctaagggtctaagggcgagatatc

SEQ ID NO: 14802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacgcttcttgatcaactcagggcgatc

SEQ ID NO: 14803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacgcttgaggcatcgaaacagttcact

SEQ ID NO: 14804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggacggataggtacttcgcctggccatgc

SEQ ID NO: 14805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagaaacgtccgaggggtacaggatgct

SEQ ID NO: 14806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagaagtattaggttaatgcgacgctcc

SEQ ID NO: 14807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagagcataacgaccgggtgtgcttctt

SEQ ID NO: 14808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagagcttgaacttacgtgatccggtca

SEQ ID NO: 14809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagattgccgagcccaaacctatagacg

SEQ ID NO: 14810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaggaggggatgctcagctcgagggagt

SEQ ID NO: 14811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaggcaagatcgcctttctagtggaccc

SEQ ID NO: 14812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaggcctctcgttgttcacctacatggc

SEQ ID NO: 14813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggagggcatatcacgctcgggtggcgtta

SEQ ID NO: 14814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaggtacagcgggcgtgattggtgtggg

SEQ ID NO: 14815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggaggtgaaacaagcacgactgaactttc

SEQ ID NO: 14816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatagtctaacactatttctccgatcgc

SEQ ID NO: 14817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatatcgaatccggatggtcctgtgcgc

SEQ ID NO: 14818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatcagcataaaggcgggcttcggtttg

SEQ ID NO: 14819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatcctttatggttctagaggttacggt

SEQ ID NO: 14820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatcgccgttattggtgaattgagttat

SEQ ID NO: 14821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatcgtacggcgcgatgagggttcgacc

SEQ ID NO: 14822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatgaagggcacggcattcgatagtcca

SEQ ID NO: 14823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggatggttagcaaacaatcaagcctaacg

SEQ ID NO: 14824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggattctatatttctggccgtgatatcta

SEQ ID NO: 14825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaaatgcggtcatgacacgcaaccggc

SEQ ID NO: 14826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaacgggtcgcgcagaggggcttaccg

SEQ ID NO: 14827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaacttagtcagatcagtgtttcctcc

SEQ ID NO: 14828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaagctggcgtttcactttggctttct

SEQ ID NO: 14829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaaggctagttgaccatagaattggcg

SEQ ID NO: 14830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaagtgttgagctgccacaagtgggcc

SEQ ID NO: 14831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaatactgaggctaggcccattgtgtg

SEQ ID NO: 14832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcacacttgtaatttacggtggtggccg

SEQ ID NO: 14833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaccgctagcaaatgagtggtcgatcg

SEQ ID NO: 14834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcacgacgatgatcccgggcccgcgtcc

SEQ ID NO: 14835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcacgccaacaccggcggacgccagctg

SEQ ID NO: 14836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcacggaggagacgatccgaggaagctc

SEQ ID NO: 14837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcacggcagaagtgttataggttgcaac

SEQ ID NO: 14838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcagcaaacttgaatccgtagttcgcgc

SEQ ID NO: 14839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcagccgttctttggattacggcacagc

SEQ ID NO: 14840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcagctaaagtgctagagtgttgcgagt

SEQ ID NO: 14841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaggcggggttgcgctttatcgcgggg

SEQ ID NO: 14842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcaggtaacagtgagccgctggttcgta

SEQ ID NO: 14843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcagtgggggttacgaattgtgtcgcgt

SEQ ID NO: 14844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcatagcacgacgtccagaacaaaagtt

SEQ ID NO: 14845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcatcaacctgacttagcgcagtgactc

SEQ ID NO: 14846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcatgctaccacctaagtcctttctggc

SEQ ID NO: 14847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcatggtacgtggtaattgctcggtgcg

SEQ ID NO: 14848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcatgtagcaaactactcgccaattact

SEQ ID NO: 14849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcattaaacgtgtctgagtctagagccc

SEQ ID NO: 14850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcattataatatggtccatatctgcggc

SEQ ID NO: 14851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcattctccgtgtgagcaagtcgggctc

SEQ ID NO: 14852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccaacgaccttcttcaacagatgtacg

SEQ ID NO: 14853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccaacgcgcttacgattgcacttgcgc

SEQ ID NO: 14854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccacacctggcatattttgatcggctt

SEQ ID NO: 14855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccagccgaccacaagtctacgactgca

SEQ ID NO: 14856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcccgctctaatgcacgcggtatgagca

SEQ ID NO: 14857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccgcggattgaagacccactgcgccat

SEQ ID NO: 14858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccgttgaagatgatgagctagtcgcgc

SEQ ID NO: 14859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcctcagcaagcgctctcgttgcttacc

SEQ ID NO: 14860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcctgtgtagctaattactcacgcctcc

SEQ ID NO: 14861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggccttgtcgcagggaggacgggtgctgt

SEQ ID NO: 14862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgacaattcatgccgatgctgattgcc

SEQ ID NO: 14863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgagtgcgaggttgtctgcgaaaggtg

SEQ ID NO: 14864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgcaaagataacacagtccaaacgggg

SEQ ID NO: 14865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgcaatttccggcgcaggctggttatg

SEQ ID NO: 14866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgcgagtcgtctgccaatacgttgggt

SEQ ID NO: 14867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgcgcgtgttccgtgttgtgtgcgaat

SEQ ID NO: 14868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgctaagggttatgtacttcaggaagg

SEQ ID NO: 14869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgctgcccaagggatctcccagcaagc

SEQ ID NO: 14870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgcttcagcgttaattatcacgctacg

SEQ ID NO: 14871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcggacgcacgcagggttgtcgagcgct

SEQ ID NO: 14872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcggcaaggtttgcaatacccggactgg

SEQ ID NO: 14873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcggtttagaagtcttgagagttcagag

SEQ ID NO: 14874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgtgcatttacccctgccgtattgcgc

SEQ ID NO: 14875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgtgtcatgtcacggcaagtgctcggc

SEQ ID NO: 14876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgtgttggatggctgtagcttcgtcgg

SEQ ID NO: 14877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcgtttaaggggagtcacgggctggttt

SEQ ID NO: 14878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggctcatgcatgggcaagaccagcaatgt

SEQ ID NO: 14879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggctctgaatgctagatcggctttcccgc

SEQ ID NO: 14880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggctgaggaagttgatgtgtcttggcttt

SEQ ID NO: 14881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggctgcggtcctttttaaatgaggcaacg

SEQ ID NO: 14882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggctggagaggatccgttgttccgactgc

SEQ ID NO: 14883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcttccgaagttttagacgagttgaagc

SEQ ID NO: 14884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcttctcggccaaatttcaacggcagct

SEQ ID NO: 14885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggcttggcgactgcggcggccgatctccg

SEQ ID NO: 14886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggaatctcgtcgcgaagttcagagaggg

SEQ ID NO: 14887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggacataaaacgatcgcctaacgtgggc

SEQ ID NO: 14888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggacccccaagcggcaaattctccacct

SEQ ID NO: 14889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggacggtcgttgagatttaaggtcttag

SEQ ID NO: 14890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggacgtacagggatgtgcgctgatgcgg

SEQ ID NO: 14891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggactcccccaccacgcgactgcgccgt

SEQ ID NO: 14892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggagaggacgtttaccgttggtgagtgg

SEQ ID NO: 14893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggaggcgccgcaacggcaggcgaaggtt

SEQ ID NO: 14894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggagggagctgttgcgggttttagccgg

SEQ ID NO: 14895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggagttccgggcattctttgctcacttc

SEQ ID NO: 14896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggatcgcactgacggtcggctacaatat

SEQ ID NO: 14897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggattccttaatagccgtggtttggcgg

SEQ ID NO: 14898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcaagagggcgcgaataccagacttcg

SEQ ID NO: 14899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcacttccatggtaggagtcgcatcac

SEQ ID NO: 14900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcagacaaagactggtcctatctggtt

SEQ ID NO: 14901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcagggttccgcagtggcgtttatgtg

SEQ ID NO: 14902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcatgcgtatttaatggttgatactgc

SEQ ID NO: 14903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcatttgtgcggatcgaaacttctacc

SEQ ID NO: 14904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggccagcatcatgtgaaaggtttcgggc

SEQ ID NO: 14905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggccagggtggcgtctctattaatggcg

SEQ ID NO: 14906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcccttccttagcggcatcccgcaact

SEQ ID NO: 14907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgaatgggcaggttctttctggggcc

SEQ ID NO: 14908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgacgacgcgcttcccttattgacgc

SEQ ID NO: 14909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgcaccacgcgttttccgtttcgcgc

SEQ ID NO: 14910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgcgtgaatgttaggcaattactaag

SEQ ID NO: 14911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgtgtcacacctgacgacgcgtttca

SEQ ID NO: 14912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcgtttgatcggagtgttcacctaatt

SEQ ID NO: 14913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggctactcggatggaatcgcactcgtgg

SEQ ID NO: 14914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggcttaaagaatcgcactcacaaatcca

SEQ ID NO: 14915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggctttcgttcttcgtaccgggggtccg

SEQ ID NO: 14916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggaacaggatgctgccggctagacgcg

SEQ ID NO: 14917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggaatatcttgttttgaatgctgcgat

SEQ ID NO: 14918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggagcgaaggacaattggggtaataga

SEQ ID NO: 14919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggattgtgatggcgtgggcgtatgcga

SEQ ID NO: 14920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggcacagtcacacggcctgcttcggcg

SEQ ID NO: 14921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggcaccctggacaccgccggacagatg

SEQ ID NO: 14922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggcacggggggtcagccaatgctggga

SEQ ID NO: 14923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggcgagtcacgatgcctggggtgctgt

SEQ ID NO: 14924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggcggggcatgtcagaacgcggcggtt

SEQ ID NO: 14925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggctactaagccactcctattgggacg

SEQ ID NO: 14926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggctgcgacggaatccagcgacgggca

SEQ ID NO: 14927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggggaacttactctcaggctggttagcg

SEQ ID NO: 14928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggggacatctaccacggcaacaagctca

SEQ ID NO: 14929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggggagcgggtgacagcggaaggtgggg

SEQ ID NO: 14930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggggctacgcagggttggataggcgagg

SEQ ID NO: 14931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggggtttgttcataaaccagtgccgtc

SEQ ID NO: 14932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtaaggaccgtaatcccatttaggaa

SEQ ID NO: 14933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtacgaggggcactattagtagcgtg

SEQ ID NO: 14934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtatacgggaactggctgcgcgatcg

SEQ ID NO: 14935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtcgaactctgtcagggaagtcgttg

SEQ ID NO: 14936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtcgaggcagaggtacggtcaacccg

SEQ ID NO: 14937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggttcgtgtttgtgcatctctcgcggt

SEQ ID NO: 14938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggggtttgagataatgcgcagctcggatg

SEQ ID NO: 14939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtagtaaatactgacgcgtccacgagg

SEQ ID NO: 14940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtagtgtatgggtttggctaggtctag

SEQ ID NO: 14941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtatcgaatggaaagtcaacattgttc

SEQ ID NO: 14942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtcagcgccgacaggatgctagaggac

SEQ ID NO: 14943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtcctgggaaactcgcagggatacttg

SEQ ID NO: 14944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtcggatgacgatgaggactatcaaat

SEQ ID NO: 14945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtctatcagtgactcatgcttagtatg

SEQ ID NO: 14946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtctcgtgaaccaggtctagggcaacc

SEQ ID NO: 14947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtgattatgggtcgttgtgaatgagtt

SEQ ID NO: 14948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtggtcttgtatctattccgtcggacc

SEQ ID NO: 14949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggtgtgttcggggacatgtgaccgcgcc

SEQ ID NO: 14950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggttaagtgtgggtctaattgatggtag

SEQ ID NO: 14951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgggttacggatagagcctgatgcgtatag

SEQ ID NO: 14952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtacccactaaactctcctgaacactag

SEQ ID NO: 14953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtaccgttcatctgctggtacatcacta

SEQ ID NO: 14954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtactacggtttgaatctgctatgtgcg

SEQ ID NO: 14955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtactgtctgtgacaacgtgtcacgtct

SEQ ID NO: 14956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtaggtgatggggtgtctcgttgacgcg

SEQ ID NO: 14957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtaggtgggcagtgcacactgatgtgcc

SEQ ID NO: 14958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtattagattgtgtactatcggatttta

SEQ ID NO: 14959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcaagagtgtggcccctcccagtccga

SEQ ID NO: 14960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcccattcaggcagtggtccggaacca

SEQ ID NO: 14961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcccttcatcgcggcgttaacggagct

SEQ ID NO: 14962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcgcggatattagtctcgcaaaaatcg

SEQ ID NO: 14963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcgttatgctgtgtagggtatgcagcg

SEQ ID NO: 14964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtctatcgttcttcacacgctgtgtcga

SEQ ID NO: 14965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtctcgcgtcttagaggacaacacttcc

SEQ ID NO: 14966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtctgggctgcaagatccatcgatgagg

SEQ ID NO: 14967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtcttgtgttgggtaagggggatgccct

SEQ ID NO: 14968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgacgggctccgtcctttcgttgttgc

SEQ ID NO: 14969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgaggagtccgttatcgttcttgcgcg

SEQ ID NO: 14970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgaggtactattggcgttttttatact

SEQ ID NO: 14971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgcaagaattttaccctctgcgcctcg

SEQ ID NO: 14972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgctctggctgcccctagtccctcgct

SEQ ID NO: 14973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtggatcgtgttacgacgatcatgtcct

SEQ ID NO: 14974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtggcctaaacccggtcgctaaaccacg

SEQ ID NO: 14975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtggcgaacagatcaacataatcgcgtg

SEQ ID NO: 14976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtggcggtcggcagatttaggctcccac

SEQ ID NO: 14977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtgggtttcctctcgggctcatcatgcg

SEQ ID NO: 14978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttatgtattatactggtaattaacttc

SEQ ID NO: 14979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttcgatatcgcgtaaggctaaaggtag

SEQ ID NO: 14980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttctgaggttcagcggcatgaccagcg

SEQ ID NO: 14981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttgaccgctttcgagagtcataccggc

SEQ ID NO: 14982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttgctgacgctcagtagggcacgtcgt

SEQ ID NO: 14983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtttacttcgttgactgatgttggggca

SEQ ID NO: 14984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtttattgggcgatcccagactgtagac

SEQ ID NO: 14985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggtttctcacggatggtgtatgaagtcca

SEQ ID NO: 14986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacggttttagcgtgcaggatagacgtgataa

SEQ ID NO: 14987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaaacttgtaatctcgagtgtaggcgtg

SEQ ID NO: 14988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaacattatcacatctaactctgattcg

SEQ ID NO: 14989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaaccggtaattgttcggacctaccctc

SEQ ID NO: 14990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaagccatgccaggggatgacactaccg

SEQ ID NO: 14991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaaggctcttgattccttctcagagtcg

SEQ ID NO: 14992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaatgaaacgctcttagagagcttcggt

SEQ ID NO: 14993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaatgtagctctatcggttgttagggag

SEQ ID NO: 14994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtacactcaccattccagagccactatgc

SEQ ID NO: 14995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtacccggacagttgtgatggcatcaaac

SEQ ID NO: 14996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaccctgcggggaagccttcggtgtcgt

SEQ ID NO: 14997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtacgaccgagcttgatagactccttgaa

SEQ ID NO: 14998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtacgcaactatcgaacactgagcggtcc

SEQ ID NO: 14999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtacgcgtcggtgatggtatggtggtagt

SEQ ID NO: 15000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtactcatccatagctgggatttgcatgc

SEQ ID NO: 15001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagagatgtgtgctggtcgtgggctatc

SEQ ID NO: 15002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagaggcacacagtgaactttaacctac

SEQ ID NO: 15003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagagtccatcggcccggatcgaaaggt

SEQ ID NO: 15004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagcggctccctgtggaatcaacgttca

SEQ ID NO: 15005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagggtttgggtcatgttacccttcgcg

SEQ ID NO: 15006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtaggttttcggttcatttcggggcggct

SEQ ID NO: 15007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtagttggggagttcgctcgcgggcccca

SEQ ID NO: 15008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtatagtccgtgtgagcgtcctcgcgcgc

SEQ ID NO: 15009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtatgcacggggtggttgtgtgcagtttg

SEQ ID NO: 15010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtatggaggccggctacatctgtgggagt

SEQ ID NO: 15011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtatgtcggtatcttatcagactggcgtg

SEQ ID NO: 15012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtattttcattccgacgtcctggcacttg

SEQ ID NO: 15013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcaacgcccatttttggactggcacacc

SEQ ID NO: 15014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcacacattgtgtttgaaccgactttgc

SEQ ID NO: 15015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcacggggcccgctacggctcagcgtcg

SEQ ID NO: 15016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcagacagggaatcaccgctcgccgctg

SEQ ID NO: 15017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcaggcgcatgtagtgttgttgtacgta

SEQ ID NO: 15018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtccacctcgcgccagtaaaacggcctat

SEQ ID NO: 15019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtccagcgctacgaatgcccacagacggt

SEQ ID NO: 15020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtccgggagggggttctgtcctgacgcac

SEQ ID NO: 15021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtccggttctacttccatagcgtatctcg

SEQ ID NO: 15022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcctacgagagacctgctccccgctcgt

SEQ ID NO: 15023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcctctatgtattcgccatcgaccgagg

SEQ ID NO: 15024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcctggaggtgggggatgcgatggggaa

SEQ ID NO: 15025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtccttacgcaaattttcggtaactcgaa

SEQ ID NO: 15026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcgaccgacatgacgactcctaggttgg

SEQ ID NO: 15027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcgcaatgtaggactaaggctggcgttt

SEQ ID NO: 15028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcggcagtgaatgtctgatatctacggg

SEQ ID NO: 15029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcgggggtatgattgttggttaagcggt

SEQ ID NO: 15030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcgtgggcactcggggtcgcctgtggag

SEQ ID NO: 15031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcgtgtatgcatttcggactcttaggcg

SEQ ID NO: 15032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtctatcgctgcgatgtatccatgtcttt

SEQ ID NO: 15033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtctgcgggtagctagtacgcgtgatccg

SEQ ID NO: 15034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtctgtgaaacggttctagtgccatggtc

SEQ ID NO: 15035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtctgttccaacttgcttaacttcgggca

SEQ ID NO: 15036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtcttgaaatgagaactctatgcagctta

SEQ ID NO: 15037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgaagggcaacatagggcccagaccggt

SEQ ID NO: 15038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgaatgatagactggcgaggagtcacgc

SEQ ID NO: 15039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgacctagcgctagtacctccttaccac

SEQ ID NO: 15040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgatcctatgttcacgcatttcttgttg

SEQ ID NO: 15041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgattattcagtttgaaatacagtggtg

SEQ ID NO: 15042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcaacacgggagtaaaagtcggtgcac

SEQ ID NO: 15043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcaggacctcgggcctccgtgtaccgt

SEQ ID NO: 15044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcatactagtggcggccttcggttcgt

SEQ ID NO: 15045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcattgagcccactgcttggcactttt

SEQ ID NO: 15046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgccaatgcgccttacggtggctactta

SEQ ID NO: 15047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgccagggacttgtagtatcatacgccg

SEQ ID NO: 15048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgccgggagttcatccgcgcggccagtg

SEQ ID NO: 15049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgccgttggctatctaatacgttgttgt

SEQ ID NO: 15050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcggagtggatctgcttaggtggccgt

SEQ ID NO: 15051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcgtcttcaagcggcatgtgtcagtgg

SEQ ID NO: 15052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgcgttgacgttcatagctcacccccgg

SEQ ID NO: 15053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctaatagtggcaggctcatatttgtc

SEQ ID NO: 15054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctaatgcatccctacgcgtggcgttg

SEQ ID NO: 15055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctacacctttgcagcttggtggggga

SEQ ID NO: 15056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctagcacccaccagaggacaaggcgg

SEQ ID NO: 15057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctcgctcgaagtttactcggttgacg

SEQ ID NO: 15058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctgactctgtcacagatcccaccatc

SEQ ID NO: 15059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgctgggcgctctctatatcttgtgttt

SEQ ID NO: 15060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtggaattaggtgggtgcactttatttcc

SEQ ID NO: 15061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtggacgacccaaacacttcccttggcga

SEQ ID NO: 15062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtggagtcatttagtacacacaagtgagg

SEQ ID NO: 15063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtggcccgtgactccggtccatacctaag

SEQ ID NO: 15064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgggacaaaatcattatttggtcgctat

SEQ ID NO: 15065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgggacgtcaggtgctcattggagcggt

SEQ ID NO: 15066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgggcttcgtgatggaaccaaggggtgt

SEQ ID NO: 15067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtaatttgtagaacgtcctgtcttttt

SEQ ID NO: 15068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtagtgtggagcttcgtaaccatctgt

SEQ ID NO: 15069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtatctgcggggatgctgcgatcgggt

SEQ ID NO: 15070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtccgttgatgtggcgtgttggtgacc

SEQ ID NO: 15071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtctctccacacgagaagtttgacccg

SEQ ID NO: 15072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtgcccggggggccgagatgattctga

SEQ ID NO: 15073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtggaccgggcacccgtttggaagtgg

SEQ ID NO: 15074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgtggtgatgaccgttcacggcctgggc

SEQ ID NO: 15075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgttaacattcgctgatgacaatgttct

SEQ ID NO: 15076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgttacgcatttcgggcagcggcgggga

SEQ ID NO: 15077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgttacgttgagttggctcgtatggaag

SEQ ID NO: 15078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgttccctaaatcgtgttctcttagaat

SEQ ID NO: 15079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtgttgtgcgacttattttggacccagca

SEQ ID NO: 15080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttaataacctacctgtctccgccgtgac

SEQ ID NO: 15081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttacatttcggttccggaggtaggtcgg

SEQ ID NO: 15082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttacggggtagactgacggctggcaatt

SEQ ID NO: 15083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttaggtaggtcatattatatctcgtcgc

SEQ ID NO: 15084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttatccgattattatgcgtcggctcgtg

SEQ ID NO: 15085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttatggagacgatggtttacttggcatg

SEQ ID NO: 15086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttcacacagtcactaacgttcccaactg

SEQ ID NO: 15087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttccaatcgcggtccctctcctgcattc

SEQ ID NO: 15088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttcctcgtcgcgcgacctggctcatgcg

SEQ ID NO: 15089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttcggcgacaacactctgagatctggat

SEQ ID NO: 15090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttcggtattcgcttcaggtggaacgtga

SEQ ID NO: 15091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttcgtacggacaatggcttatcaaaggg

SEQ ID NO: 15092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttctcgctaagtttatgttctgtactca

SEQ ID NO: 15093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttctgatgctgccaatcttgttgtcggg

SEQ ID NO: 15094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgacccgcaggcggcaccgcaccgctt

SEQ ID NO: 15095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgacgtactagttagttcaccccggtt

SEQ ID NO: 15096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgagcaaactcccggattttttgttac

SEQ ID NO: 15097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgatataattgatgactcacggccacg

SEQ ID NO: 15098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgcggcgtgcggcgcgtcattcattac

SEQ ID NO: 15099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttggactccctacgtgttgaggcattga

SEQ ID NO: 15100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttggcagaggacctagaaacgagcccgc

SEQ ID NO: 15101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttggcattcggtccacctttgccgtgtg

SEQ ID NO: 15102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttggctatcacatcctgctagtgtcccc

SEQ ID NO: 15103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgggtactacacggaacatgggcatcg

SEQ ID NO: 15104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgttgtcctttgccgccatgagagtgacgg

SEQ ID NO: 15105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtttacaatccgctcaatgtgaaatgcca

SEQ ID NO: 15106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtttatcgaggggttgagcgctattgcgt

SEQ ID NO: 15107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacgtttgtgtactttacgtgtactctggatg

SEQ ID NO: 15108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaaactgacaacctattcacacggtaaa

SEQ ID NO: 15109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaaagtagctctgacttgtacgtcctgc

SEQ ID NO: 15110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaactgggttgcttttccaggagcgcgt

SEQ ID NO: 15111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaagcacccctgggttagaccgtgtctc

SEQ ID NO: 15112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaagttcgatgcttcaaaagtacatcat

SEQ ID NO: 15113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaagttcgggtgaagggaactggcggcg

SEQ ID NO: 15114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaaccggtctccaaatacagcgttggcgc

SEQ ID NO: 15115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaacgatggtccggtttcgagagtataga

SEQ ID NO: 15116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaacggtgtaagataatcgagcggcacgc

SEQ ID NO: 15117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaagacggcacgtgcgtcttcattacgca

SEQ ID NO: 15118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaagatcgtggccattcagtgtcgggacg

SEQ ID NO: 15119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaagtttcttgccctattcgctttaaaag

SEQ ID NO: 15120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaataattgtcatgtgattccataagccg

SEQ ID NO: 15121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaatatcggcatatcgcgcgtttttgagt

SEQ ID NO: 15122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaattatagggatgctaggcggcggtgta

SEQ ID NO: 15123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacagaagcagagaagctacctcggacgg

SEQ ID NO: 15124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacaggccaccagaattagccaatcaagg

SEQ ID NO: 15125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaccagtattgctacctttatattgccac

SEQ ID NO: 15126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaccggtggcggtccccaatccataatac

SEQ ID NO: 15127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaccttgcgtgggtacagttcatggttgt

SEQ ID NO: 15128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacgagccattcactgcggaaacgcaggg

SEQ ID NO: 15129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacgcggtcatgaaaatgcgtccggggtg

SEQ ID NO: 15130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacgctctacggtatatataggctgcact

SEQ ID NO: 15131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacggtgtgcgagccacggcctcaaagat

SEQ ID NO: 15132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacgtgaacgctttctgtcgttgccggac

SEQ ID NO: 15133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacgttgaaacatgtgtggtgaacgggga

SEQ ID NO: 15134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactactagacactggtgaagttccctgccaa

SEQ ID NO: 15135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactactggctcagttctccgcccgcgcaagg

SEQ ID NO: 15136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactactgtcggggccgacgcttctgggaccg

SEQ ID NO: 15137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacttacttcacggactggggttaaagag

SEQ ID NO: 15138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactacttatacttggattggattgtttaata

SEQ ID NO: 15139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagaggttcagcaatggggttggttcacg

SEQ ID NO: 15140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagatctttacgttcctgcttacggacca

SEQ ID NO: 15141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagatgccataccggctgctctaccgggt

SEQ ID NO: 15142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagcaagacaccgccaacgtggttcgaat

SEQ ID NO: 15143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagcaccgctgcttgggtagaaaatcggc

SEQ ID NO: 15144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagcgaaatctgcttcatgcaatcgttcc

SEQ ID NO: 15145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagctcgagggagaaggtccggtggcgcc

SEQ ID NO: 15146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagctcgtacgtcctacgctcatcgctgg

SEQ ID NO: 15147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggacaccggtgacttcgttgcgttcct

SEQ ID NO: 15148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggagcgcggcgcaatttagctggcctt

SEQ ID NO: 15149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggattgggggacattagcttcaggggt

SEQ ID NO: 15150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggcactcgggattaccgggcactctgc

SEQ ID NO: 15151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggcaggtgattggctttgtttggcgct

SEQ ID NO: 15152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggccgtgtcggggcacggggacgcgga

SEQ ID NO: 15153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggcgggcattcagggctttagcccaga

SEQ ID NO: 15154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagggatggctgatctctcacaaactcaa

SEQ ID NO: 15155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactaggggcgccaataactcgatggatcctc

SEQ ID NO: 15156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagtatgttagtttgtcttctgatatatt

SEQ ID NO: 15157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagtggcttatcagtctataaattcatac

SEQ ID NO: 15158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactagttggaacaacccagcaggttacctca

SEQ ID NO: 15159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatactaaggctctaggagcacgtagttc

SEQ ID NO: 15160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatatcgaggaaacacggtttgtgtgctg

SEQ ID NO: 15161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatatcggaggactacagcatcaacactt

SEQ ID NO: 15162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatatgcttttttccacccttaacggcta

SEQ ID NO: 15163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatcacatagtcgctcgtcgcggggtacg

SEQ ID NO: 15164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatcacggatccactcaggagggcagctc

SEQ ID NO: 15165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatcatagtctgaggcccccgttccattc

SEQ ID NO: 15166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatccgcaaaaacttggagcatagcagta

SEQ ID NO: 15167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatccgcgtgtccctatggcctgttgtgt

SEQ ID NO: 15168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatgatcgggatccggcgagtggtccggc

SEQ ID NO: 15169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatgcattaaacggggccggacttcctac

SEQ ID NO: 15170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatgcgcgtttctctaagcgtgactcagg

SEQ ID NO: 15171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatgcggaggctaatatggtgtgcagctt

SEQ ID NO: 15172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatgcggtatgtttttttcccacacggcg

SEQ ID NO: 15173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatggagtaaatctaagcgttgtacagtg

SEQ ID NO: 15174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatggcttggacgcgggtacgaattcatt

SEQ ID NO: 15175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactattagcaagttcggggggtcgagcgagc

SEQ ID NO: 15176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactattatgtgcatgatgtccctcacgcttt

SEQ ID NO: 15177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactattcggacagcagttgttcgttctctgt

SEQ ID NO: 15178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactattgcagccgactagtgatcagcacatt

SEQ ID NO: 15179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactattgttgctttacctcccgtttcccttt

SEQ ID NO: 15180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatttatacgaagttcttttagtttctat

SEQ ID NO: 15181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatttattggtcctttttttggctgtgtc

SEQ ID NO: 15182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactatttgcatggaggtaccggttacactta

SEQ ID NO: 15183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaaactatcctcccgccgcgaactcggg

SEQ ID NO: 15184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaacagctgttcacgtggtctcacacat

SEQ ID NO: 15185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaagtccaacggacgttctgcaatggcg

SEQ ID NO: 15186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaatagcgctcgggccgccacatactta

SEQ ID NO: 15187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaatcgcataaggcctcctcgcagtcac

SEQ ID NO: 15188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaatcggcacggaaagtccttcatcacg

SEQ ID NO: 15189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaattggatactaccatgtggggctaag

SEQ ID NO: 15190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcacatggacgtggactgaccaatcaatc

SEQ ID NO: 15191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcagacggcgattgggaatttcggctatt

SEQ ID NO: 15192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcagagcccatgtgtacagccccaggcgg

SEQ ID NO: 15193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcagcgcaggtattcactaaatcttgctt

SEQ ID NO: 15194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaggcttcgcgcaaactcgatcgtgggt

SEQ ID NO: 15195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcaggttagccggctacaataaacatcga

SEQ ID NO: 15196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcagttcaccagatcccatccacgtggcg

SEQ ID NO: 15197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcatacctcgcctctatgcattatagtac

SEQ ID NO: 15198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcatcacagctactttccttatatctttt

SEQ ID NO: 15199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcatccgttcgttgtgacgacactttagc

SEQ ID NO: 15200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcatgagggttctcggcatcgtctgcccc

SEQ ID NO: 15201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcattagacgagcggggttgcggatgtct

SEQ ID NO: 15202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcattcctttatttcagttgcagccaggg

SEQ ID NO: 15203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccaaactaacgtgcaaggcttccctcgg

SEQ ID NO: 15204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccacgctcggcaagaccagttgtgggcc

SEQ ID NO: 15205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccactggcatgccggcggaattgtgtcc

SEQ ID NO: 15206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccagggtatagctttcggccttgggga

SEQ ID NO: 15207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccccagtagctgtagtcttagcgctgat

SEQ ID NO: 15208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccccagtttctacctcagtgtttggtgt

SEQ ID NO: 15209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccccaatgggacaccacgtcaatagta

SEQ ID NO: 15210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccccctcgcccgaaggacccccgtcca

SEQ ID NO: 15211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccctggccttacgcttcttttgcgcct

SEQ ID NO: 15212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccgtatcctcggaatcatggggagccg

SEQ ID NO: 15213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcccgtgtaagtggcgatacaatgacagt

SEQ ID NO: 15214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccctctggaaaacgtaaattcggactct

SEQ ID NO: 15215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccctctgtgtctcacgaacacttaagag

SEQ ID NO: 15216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgacacttcggctctcccgcacccttc

SEQ ID NO: 15217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgctttgatcccttacgtccgagaatg

SEQ ID NO: 15218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgggactctaggtacattttttaggac

SEQ ID NO: 15219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgtctgtttatgcctgtcccttgccgg

SEQ ID NO: 15220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgttattcacagtttacacgttgttga

SEQ ID NO: 15221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactccgttcgctcgcgttattgctacaggat

SEQ ID NO: 15222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcctgatagcggtactgagctactcggca

SEQ ID NO: 15223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcctgcaagcaatgctcgcgctgtggttg

SEQ ID NO: 15224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcctgcggtgtcttctcggtttgatgggt

SEQ ID NO: 15225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcctggaacgctggattgccgccactttt

SEQ ID NO: 15226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcctttattcggcctcccgagcatcgaac

SEQ ID NO: 15227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgaacagggtcgctcaatggccaactgg

SEQ ID NO: 15228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgacatgacactgtggttaataatgctt

SEQ ID NO: 15229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgaccccgggtgagtggaagactcgtac

SEQ ID NO: 15230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgactgatcggggtacaccccgccgcgt

SEQ ID NO: 15231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgagactcgggtgggatgatgacgatgc

SEQ ID NO: 15232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgaggtgatgcagtgtttgacggttgag

SEQ ID NO: 15233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgagtaactgcacacgttaggctccacc

SEQ ID NO: 15234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgagtctggtgtgctgccaacggcttgg

SEQ ID NO: 15235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgattgtaccaggaccattggatccctt

SEQ ID NO: 15236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgcacgcgaacactttggttaggcggca

SEQ ID NO: 15237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgcagggcatggttgagcggtgcgcgta

SEQ ID NO: 15238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgcgcgacgtggcggttccctttcgctc

SEQ ID NO: 15239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgcgttactagcacccaaacgaacgcgc

SEQ ID NO: 15240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgctagtttggctgtaaaccaccagagg

SEQ ID NO: 15241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgctcgcagcgacatacaggttcagtcc

SEQ ID NO: 15242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgctcgggattattttagcctattctca

SEQ ID NO: 15243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcggcgccgcagacgtctgttccggaggg

SEQ ID NO: 15244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcggggacagatcgtatgagaatgggtag

SEQ ID NO: 15245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcggttgcataacgaatgttcccagaacg

SEQ ID NO: 15246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgtaataaaggcaccgcgttcttgcagg

SEQ ID NO: 15247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgtagtctgatgtcttggcagacgtatg

SEQ ID NO: 15248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgtccgcatggtgcattttgacattttt

SEQ ID NO: 15249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgtgtaccccgcgtccgctttccgaatt

SEQ ID NO: 15250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgttattttttggaaatgcgtgcacatc

SEQ ID NO: 15251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcgttgttacgcgaatccgctccgttatg

SEQ ID NO: 15252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctaactagtggcactaaattcccggaga

SEQ ID NO: 15253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctaattcgtctagggctcgcaaagctgg

SEQ ID NO: 15254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcaaagtccgaaatgccgcgggctaac

SEQ ID NO: 15255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcaattttttactatgtgctcgacggt

SEQ ID NO: 15256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcccgctatggccgcccaatggtagac

SEQ ID NO: 15257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcccttggacatgcgaagtcgggtagg

SEQ ID NO: 15258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctccctttaactttcgaataaacaatgg

SEQ ID NO: 15259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcgaagtttacctccggaagggtgacg

SEQ ID NO: 15260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcgattttacgttgtgtaccacagccc

SEQ ID NO: 15261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcggttgacttcgcaagttctggtcgt

SEQ ID NO: 15262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctcgtgttagcttttacgatcgtggccc

SEQ ID NO: 15263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctgccaaagccaggtcgaccctcggcct

SEQ ID NO: 15264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctgctctggttatgggaaccgttgggtc

SEQ ID NO: 15265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctggaagtccttttattgcagcgttttg

SEQ ID NO: 15266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctgggagactttccaagcatgtttaagc

SEQ ID NO: 15267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctggttggcatctttgacgattgtagac

SEQ ID NO: 15268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctgtcagaggggcttttcgatcactcgc

SEQ ID NO: 15269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactctgtcgatgagaaagaattaaggcggag

SEQ ID NO: 15270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcttaagtctcgattgacggcgtggctag

SEQ ID NO: 15271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcttatactgttcgttcaacttctgactt

SEQ ID NO: 15272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactcttttgtccaagcagcactcgcctccca

SEQ ID NO: 15273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaaaccctccgggtgatgtcacggtcct

SEQ ID NO: 15274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaaattagcgtttttcgtcaacgcgatc

SEQ ID NO: 15275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaacatgcagaagtcacttgcgttggga

SEQ ID NO: 15276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaacctaacggtcattaccatggtcacg

SEQ ID NO: 15277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaagagctttatggtgctggttctgatt

SEQ ID NO: 15278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaagctgctatatgttcgcgctttaaac

SEQ ID NO: 15279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgacaacctagggtagagcactctctcaa

SEQ ID NO: 15280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgagccattcgtactacaatcacttactt

SEQ ID NO: 15281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgagcgatgttatcggtcgccctcggtcc

SEQ ID NO: 15282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaggacgggacgtggttttggatgatct

SEQ ID NO: 15283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgaggtttacccattgcctcgaggtcgat

SEQ ID NO: 15284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgagtcatatctccacaaatgggggcgcg

SEQ ID NO: 15285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgagtctctagatggggctgttcgaatgg

SEQ ID NO: 15286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgatgagacgtccgagattctcttagtgg

SEQ ID NO: 15287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgatggcacacggactagattaggcgatt

SEQ ID NO: 15288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgatggtattgggtactattgcggatccg

SEQ ID NO: 15289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgatttagtgtcgggtgcattctccgggc

SEQ ID NO: 15290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcaagtccgcacgtctcgggttttagtc

SEQ ID NO: 15291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcacgcacttaaaggggtaatatttcga

SEQ ID NO: 15292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcacgtttgaatatgtgccggcttatca

SEQ ID NO: 15293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcactgcggccgagcaaaggactcgctc

SEQ ID NO: 15294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcagttcttgggacgggcgtcacaatcg

SEQ ID NO: 15295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcatgaacgtacggcgatgtgcttggag

SEQ ID NO: 15296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcattaccccgacgagtggagtttcccg

SEQ ID NO: 15297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgccagttatggttgcttatgcgggactc

SEQ ID NO: 15298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgccatagttgcccaaggaacttgtgagg

SEQ ID NO: 15299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgccccgggcctaatggttcgtcacgcca

SEQ ID NO: 15300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgccctggtcgctcggtcacgaagcaagg

SEQ ID NO: 15301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcctgtatctactcgtgcctggaaaata

SEQ ID NO: 15302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgacttcttccctagttctatctctca

SEQ ID NO: 15303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgcaacttgcatgcaagcactgctcat

SEQ ID NO: 15304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgcacacgaagcatcgatgtttgccga

SEQ ID NO: 15305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgcgtctagtatggtttgtgtcatacc

SEQ ID NO: 15306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcggaagatacttctgagcgggtgggtc

SEQ ID NO: 15307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgtaacttgacatgatcgtaagcatac

SEQ ID NO: 15308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgcgtataagttattgggcgggggtgggt

SEQ ID NO: 15309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctaacgtagaggatggtccggtcaata

SEQ ID NO: 15310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctaccgattcggcccgcttgcgtggag

SEQ ID NO: 15311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctacctttgcgaactgtcgccgtcgtc

SEQ ID NO: 15312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctcgtgggtagcactaagcccgagaca

SEQ ID NO: 15313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctcttttatatctccggtcaactccgt

SEQ ID NO: 15314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgctggaataccaatcggcggcgttgctt

SEQ ID NO: 15315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggaaccagggtttgtgcacgatcgggcg

SEQ ID NO: 15316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggacaaggcctgtccgcgtcacctgggc

SEQ ID NO: 15317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggacgaccaatggcctggacctcctctc

SEQ ID NO: 15318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggactacccttatgaacttgcggattcg

SEQ ID NO: 15319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggaggtccggacgttggtgtgtttctac

SEQ ID NO: 15320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggatcccctcacgcctcatcctctgtga

SEQ ID NO: 15321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggcaaagtggtcaccttggcttgtggta

SEQ ID NO: 15322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggcacgcgcgcgctatcagcggttcatt

SEQ ID NO: 15323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggcagaccgagggcgcgggactctggtt

SEQ ID NO: 15324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggcatgtgtatcaggcagcctgcggggc

SEQ ID NO: 15325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggccagttgatttgagctcacgtacacg

SEQ ID NO: 15326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggccagtttcccctgttaggcttcagca

SEQ ID NO: 15327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggcctcggtctcaacatgcaggacgtcc

SEQ ID NO: 15328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggctagtgtgcttaccctggctttcgac

SEQ ID NO: 15329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggctcggttccattgggctcatcggcgc

SEQ ID NO: 15330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgggcgtaggcggttataatctgtgcgag

SEQ ID NO: 15331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgggctatcgggagatgttgggtattgtt

SEQ ID NO: 15332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggggcggttcatcattctttgatttgtc

SEQ ID NO: 15333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgggtaaagcagtggaatgtctggcgcgt

SEQ ID NO: 15334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgggtagcagatggacgggtcttggcata

SEQ ID NO: 15335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgggtggatgtagtcctgctcccccgttc

SEQ ID NO: 15336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtacgtaggtcgccactactactccgc

SEQ ID NO: 15337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtatacggcatggggacacgaaggggc

SEQ ID NO: 15338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtcactgagtttgtaatgtgtggtttc

SEQ ID NO: 15339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtgatgtgtctcggttgatcactaatt

SEQ ID NO: 15340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtgcatgtgatggtccgggattgacct

SEQ ID NO: 15341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtgccacagcttgcggccgcactccac

SEQ ID NO: 15342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtggaggctccatcccgattaggctgt

SEQ ID NO: 15343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactggtttacgctccaacaagcagtaatggg

SEQ ID NO: 15344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtaattcacggcagctcaatacgtcagg

SEQ ID NO: 15345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtacagacagaacgctaacgccggactc

SEQ ID NO: 15346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtacttatatcaggtgtttggttttgtg

SEQ ID NO: 15347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtacttggaatccctcaatctatggctt

SEQ ID NO: 15348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtatccgatcagcttgggctactgtggg

SEQ ID NO: 15349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtattttactggcgatccgtgaccgggg

SEQ ID NO: 15350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtcaccctacgcttgcttgcgatgacca

SEQ ID NO: 15351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtccggggtagcgtatgttggcatttac

SEQ ID NO: 15352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtcctgaactagttggcatgttattaag

SEQ ID NO: 15353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtcggtaatggttatgggcgcacacccc

SEQ ID NO: 15354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtctgtgtaaatggtgcgatttagggtg

SEQ ID NO: 15355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgacgtatttgtcgttatcgttcctgt

SEQ ID NO: 15356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgagaatattactgtactggttttgta

SEQ ID NO: 15357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgagttctctcaaggcgacgtgtactt

SEQ ID NO: 15358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgatagcatcgccccctacgatgacgc

SEQ ID NO: 15359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgcaggtctgtaatggacgattccgtc

SEQ ID NO: 15360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgcgacatgtacagcggcaaccgaagt

SEQ ID NO: 15361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgctggcgagttctttgaccgagcggt

SEQ ID NO: 15362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtggcgcatgtctgctccgaccacgtgc

SEQ ID NO: 15363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtggcgttcttttctagctttttagcgt

SEQ ID NO: 15364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtggctgcttcccaaattgtgttagcgc

SEQ ID NO: 15365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtggggtatgtgtacgaggtcttagttt

SEQ ID NO: 15366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgtgtgctacaccgactatcggctgcg

SEQ ID NO: 15367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtgttatcccagcggatgagtggaggaa

SEQ ID NO: 15368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgttatccttggggagttccttggacagg

SEQ ID NO: 15369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgttcgcttatgatttccggcatactcgc

SEQ ID NO: 15370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgttgtcgatgcttctcgcgtgcgagctg

SEQ ID NO: 15371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgtttagcgtcccgttgcgagtttttacc

SEQ ID NO: 15372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactgttttggcttcatatcgtgcgtgtaaac

SEQ ID NO: 15373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttaaacatccccgactacgtaggtccttc

SEQ ID NO: 15374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttaaactctggccggcgtggttatcttcg

SEQ ID NO: 15375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttaaccctaacatggacactcggggggtg

SEQ ID NO: 15376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttaagacccgtgcggcagcggcctgtagg

SEQ ID NO: 15377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttacacggacttagtgcttccttcgcggc

SEQ ID NO: 15378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttacactccgggctggtaccttgcagact

SEQ ID NO: 15379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttaccggggctgccggcaccagtccagtc

SEQ ID NO: 15380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttacgagtggaagtagaccccagtagagt

SEQ ID NO: 15381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttacgcgtccactttacgatatggaattg

SEQ ID NO: 15382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttagcatatggatatggacatgcccggag

SEQ ID NO: 15383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttagctttgtttatttgatcaggtcgggc

SEQ ID NO: 15384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttagtcctgggcctcccagtgtcagaggg

SEQ ID NO: 15385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttagtgtcggtggtcatcttggtatgtgt

SEQ ID NO: 15386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttataacgccttatttagttggcctgcgc

SEQ ID NO: 15387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttatcgccgccgactgatagctgggtatt

SEQ ID NO: 15388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttatgaagttgtacacatggcaattgtga

SEQ ID NO: 15389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttatggggcgcactggttacgttttgacc

SEQ ID NO: 15390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcaaaccgacaaacgacttgacgattgt

SEQ ID NO: 15391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcacaataaacacttggcttgcatcttt

SEQ ID NO: 15392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcactcctatttagaaccgctttttgtg

SEQ ID NO: 15393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcagcagcgaagccaattgttgcgacgc

SEQ ID NO: 15394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcagcgtcgggtgttcctcatcggttag

SEQ ID NO: 15395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcatctgattgacttgacaggaagtacc

SEQ ID NO: 15396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcattggggtcacaaacttgctagtaag

SEQ ID NO: 15397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcatttgctgtcccgagagggccggacc

SEQ ID NO: 15398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttccaacttaccttgctttacaggtgctg

SEQ ID NO: 15399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcctcacaccagacctcgcctaggtgct

SEQ ID NO: 15400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcgacagttaaagcctatacctgggtgg

SEQ ID NO: 15401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcggggtaagtctagtggctccttgggc

SEQ ID NO: 15402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcgtgttgttgaaatgccgaactgttcg

SEQ ID NO: 15403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttctatcttggaatcgttcgcttctctaa

SEQ ID NO: 15404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttctctaccaaggttggggtgtatgaccc

SEQ ID NO: 15405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcttatcgagcggacccccccctttatg

SEQ ID NO: 15406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttcttcggtacacgggctccttctcgcgg

SEQ ID NO: 15407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgaacgatccttgagaccgtgtcacgta

SEQ ID NO: 15408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgaatcctgtgcatatgcgacctcggtt

SEQ ID NO: 15409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgaatctggttctcccgcacccggcact

SEQ ID NO: 15410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgaggggcaagcctacgcgctggagtcg

SEQ ID NO: 15411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgaggtaacgtgttatgggcgtgctggc

SEQ ID NO: 15412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgatctcgtcaaaggagtagtattggta

SEQ ID NO: 15413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgccagtcgagaagctattctctttcgc

SEQ ID NO: 15414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgctactcccctcgctaggagtctgatt

SEQ ID NO: 15415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgctactcttagcttcagtctcctcgaa

SEQ ID NO: 15416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgctggccgttaagaggccctgttccta

SEQ ID NO: 15417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgctggtctcgttcatttcatttgccga

SEQ ID NO: 15418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgctgtttaatgcagcctgggactcctt

SEQ ID NO: 15419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgcttgcggctagatacgatcgccaatc

SEQ ID NO: 15420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgggggtttgacctgccgcagttactac

SEQ ID NO: 15421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgggtgggctgtaacgggtttgggaaag

SEQ ID NO: 15422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgtactctatcattcattattgctgctc

SEQ ID NO: 15423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgtcaggagtcgacgaggttctgcatta

SEQ ID NO: 15424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgtgtagtcaacattttactggtgtcgt

SEQ ID NO: 15425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgtgtttgtctcgatcgcagggcgctgg

SEQ ID NO: 15426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttgttaaacgcgtgttcctcggtgcgcga

SEQ ID NO: 15427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttaaaacaatgatcacaacgttggaatg

SEQ ID NO: 15428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttacaccacaactacctagatgggacag

SEQ ID NO: 15429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttacatcgaagggaacgtcgggccctat

SEQ ID NO: 15430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttacggagtttgattggtggtattcagt

SEQ ID NO: 15431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttcacctcggatgttaacatatagcatc

SEQ ID NO: 15432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttccacgcccggttcacgactggagccg

SEQ ID NO: 15433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttctgcacggcgtgacttactcttcgcg

SEQ ID NO: 15434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttcttcagttgcctcccctccctagttc

SEQ ID NO: 15435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgacatgcgtgtcggctttttgtacgg

SEQ ID NO: 15436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgcacggacgccgagcgatggaccacg

SEQ ID NO: 15437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgcaggaggcacgctggtagtttggtt

SEQ ID NO: 15438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgcatacggttgcaacggttttgtctt

SEQ ID NO: 15439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgcccttctcgttgcctcgtggttgtg

SEQ ID NO: 15440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttggagagctccgcgacaccacgacacg

SEQ ID NO: 15441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgtgtacccatatggtgcgcgccttct

SEQ ID NO: 15442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cactttgttaagaggcggggttcagcattctc

SEQ ID NO: 15443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttttagaaccatttatttgcgggcggtgt

SEQ ID NO: 15444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttttattcatattaattacaggtgtgtta

SEQ ID NO: 15445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cacttttgggcacggtcaagcgaatccgtgtt

SEQ ID NO: 15446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaaagtgggcatttggcgtgttaagcatt

SEQ ID NO: 15447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaaatgttgcaatcagcgtgtattggtct

SEQ ID NO: 15448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaacacctcagtcgatcgaatgagctaag

SEQ ID NO: 15449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaacagagtagtgaccgttatcttcccca

SEQ ID NO: 15450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaacgaattaggcaagcgatcaggttgta

SEQ ID NO: 15451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaacggcgcagatggagcacagtgtctgg

SEQ ID NO: 15452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaacggtcacgccggtaaaggacggagcc

SEQ ID NO: 15453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaactgggaatgtgccagggttgcatatg

SEQ ID NO: 15454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaagcgagaggaacccggcgcacctttct

SEQ ID NO: 15455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaagtagggcaacacagtcccgtagaagg

SEQ ID NO: 15456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaagtgaactcatcgcttgtgtagcctgc

SEQ ID NO: 15457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaagtgtatacaaaattcgcgctcgtata

SEQ ID NO: 15458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaatcactccgcttactcaaatgacatgg

SEQ ID NO: 15459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaatggtcaatcccgttgtgtgagcttgt

SEQ ID NO: 15460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaattgcactttccctagaggctcatagc

SEQ ID NO: 15461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaatttcgggcaatccactgcgagctcgt

SEQ ID NO: 15462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacactcacaacgatgcacagttagtccg

SEQ ID NO: 15463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaccatattctggatgggagggaggcggt

SEQ ID NO: 15464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacccatgtgtgagaggcgtttgcaattg

SEQ ID NO: 15465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaccggtgccagctcgggttttctgatag

SEQ ID NO: 15466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaccgtcaaattcacccactctagtcgag

SEQ ID NO: 15467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacctgagccgagggcccggcagttctta

SEQ ID NO: 15468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaccttgttgcaagtaacgtagcatcctt

SEQ ID NO: 15469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacgagatcagtccgtgtcagcaatgagt

SEQ ID NO: 15470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacgccaaacgagtcggtctcacgcctat

SEQ ID NO: 15471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacggtaggagctcttgttggccggtcaa

SEQ ID NO: 15472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacgtgcaaggactatcagtgtgacgcca

SEQ ID NO: 15473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacgtggccgtgccatacctttactagtg

SEQ ID NO: 15474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaactctcgcgcggcagccagctatcgccg

SEQ ID NO: 15475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaactgctatcatctgggctccactggggc

SEQ ID NO: 15476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaacttgcaagtgcgtgcagttatcgctcc

SEQ ID NO: 15477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagagaacgctcgtccagtattgctaagt

SEQ ID NO: 15478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagagcttcggacgtgtcgggtatggaac

SEQ ID NO: 15479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagaggggcggagttctcggattaagatt

SEQ ID NO: 15480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagatttcacggtgtttcgttgcccttcc

SEQ ID NO: 15481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagcacctccacaagctgggagggttagg

SEQ ID NO: 15482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagctcggaggacagattgtaccggcacg

SEQ ID NO: 15483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaggcagttcggataccggtgccgccggg

SEQ ID NO: 15484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaggcgaggttacatcacattacattctg

SEQ ID NO: 15485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaggcgtgatggcatcaattcggagcgcc

SEQ ID NO: 15486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagggaagcggaaggggtggcagcacgtc

SEQ ID NO: 15487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaggggcggaggcatatacgggaggcccg

SEQ ID NO: 15488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaaggtgctcgtaacatctactcatgtccc

SEQ ID NO: 15489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaagttacgttcaatggggcgggccggtgc

SEQ ID NO: 15490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatagcaaccgtttaacgtggcagatagc

SEQ ID NO: 15491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatcgcaatcagtggctccagttcacttt

SEQ ID NO: 15492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatcgcgccgtccatcggatccagtgggg

SEQ ID NO: 15493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatcgtcaacacgctgcatccaacgctga

SEQ ID NO: 15494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatcttcactcgagccctggtttggtatg

SEQ ID NO: 15495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgagggatttagatcggcgtactcact

SEQ ID NO: 15496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgcatcttcgttggtaggtggcgggcg

SEQ ID NO: 15497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgctcagccgtctttatgcttaggtgc

SEQ ID NO: 15498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgggggcaatcacgaacatgtgatctc

SEQ ID NO: 15499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatggtggactccgaagttatgtggatta

SEQ ID NO: 15500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgtcgcggtccgtcaaggggtcagggt

SEQ ID NO: 15501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatgtcgtcgtcctaagatccggtcagtc

SEQ ID NO: 15502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaattcaagagcgttctctgagtgccatcc

SEQ ID NO: 15503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatttctgtcactcatctttctttaagca

SEQ ID NO: 15504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaatttggccgcgggcagggggtggattgg

SEQ ID NO: 15505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacaagggcgtcggtcatccgcacaggtac

SEQ ID NO: 15506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacaagtattcgcctcgggacctgcgtgct

SEQ ID NO: 15507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacaatctgttatctgtccgcttgatttta

SEQ ID NO: 15508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacaatttcgcggctcacctggcttgcttc

SEQ ID NO: 15509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacaatttgttctttatcagatgctcgagt

SEQ ID NO: 15510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacacagttcatttcccactagcccgtcgg

SEQ ID NO: 15511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacacctcacagcgggtcccttggcggata

SEQ ID NO: 15512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacacgaaggcgaattaggttgcttgcagg

SEQ ID NO: 15513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacacgatccacacggctgctctgccagta

SEQ ID NO: 15514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacacgtgaccagcaggtatcctgaatagt

SEQ ID NO: 15515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacactggggggggttatttccggtccttg

SEQ ID NO: 15516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacactgtcggagaggctaccctactgata

SEQ ID NO: 15517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagaatcacaacctgttcggcgaagcgg

SEQ ID NO: 15518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagaccattccactatgggctatacacc

SEQ ID NO: 15519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagcacgatgggacggactctcatggtc

SEQ ID NO: 15520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagggggtgccgaaacgatttcctggtg

SEQ ID NO: 15521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagtcgcggatcagcaccacctccattc

SEQ ID NO: 15522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagtcggcggattacatgtccgaacttt

SEQ ID NO: 15523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacagtgcaccgtggtcgtgggttggcgag

SEQ ID NO: 15524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacatccttcaacagcttcgcttgcatccg

SEQ ID NO: 15525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacatctatgaagccgttgggtaggggatg

SEQ ID NO: 15526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacatctcggcatgattcattattcgtagc

SEQ ID NO: 15527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccaaactccatcatttaggttcgtgggg

SEQ ID NO: 15528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccaacgacgtcactacgatttgtacgtt

SEQ ID NO: 15529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccaacggacagcagctgagacctgattc

SEQ ID NO: 15530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccaagcaggagcgacagggacgagcgcg

SEQ ID NO: 15531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccactaagtgcccttccacttttcagaa

SEQ ID NO: 15532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccactcatctcggcgccagtgtggtgcg

SEQ ID NO: 15533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccactggttggtaaggttaatgacgccg

SEQ ID NO: 15534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccagctcgatatagcacgcaaccctcgg

SEQ ID NO: 15535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccagctcgcccccccaccgagtggctgg

SEQ ID NO: 15536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccaggaagcttacagatttcggagcgtc

SEQ ID NO: 15537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccagtttgacgtaccgatatcatatatg

SEQ ID NO: 15538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacccggagtaaccggactttgcagccgca

SEQ ID NO: 15539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgagcctacgagcagttttgccataca

SEQ ID NO: 15540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgatatgcacccacttgccagctcttg

SEQ ID NO: 15541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgatcctaggatgatttgttgattgcc

SEQ ID NO: 15542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgatgactcccggcctcggaacaacca

SEQ ID NO: 15543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgattaggttgctgtcggttctaagtg

SEQ ID NO: 15544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgtcggttgagcggcagcatgacgttg

SEQ ID NO: 15545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgttacccccgccccttctcatccagc

SEQ ID NO: 15546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccgttacgtcctcagaaacagtgacaga

SEQ ID NO: 15547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacctaaacaataggcgtgggtacggttcc

SEQ ID NO: 15548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacctaccttagccgaatcaagatctgatg

SEQ ID NO: 15549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacctcatttgaaccatactataatactgg

SEQ ID NO: 15550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacctgtagcctcaatcaagacggttgggg

SEQ ID NO: 15551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaccttggcacggcggcggaatcgagttag

SEQ ID NO: 15552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgaacgcaagaaccgagcggcggaaacg

SEQ ID NO: 15553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgaacggatcgttacttttcaacagaca

SEQ ID NO: 15554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgaacggccgcattgagctccgcaacct

SEQ ID NO: 15555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgacttcgatgatagattgcctccgtaa

SEQ ID NO: 15556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgatccggattgtgttggtaccttggag

SEQ ID NO: 15557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgcacacattcgagaaaccgtgttccgc

SEQ ID NO: 15558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgcacgaccggcaccatttgtgtgtgaa

SEQ ID NO: 15559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgccttatcgttgcagggcctaaagtgc

SEQ ID NO: 15560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgcgatggcgggctatgtgtaagccccc

SEQ ID NO: 15561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgcgtgagttcgatggaggcacgacggc

SEQ ID NO: 15562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgcgtgccacgacccccaagctgctctc

SEQ ID NO: 15563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgctccacgaatgggttacggttgcgca

SEQ ID NO: 15564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggaacgcccctaactacactaggcgcc

SEQ ID NO: 15565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggagaatgaactcaagcggcatatgcg

SEQ ID NO: 15566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggcgacaccccacaacacgtgatatgg

SEQ ID NO: 15567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgggctcctaaaataccctattacgttt

SEQ ID NO: 15568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgggtactggcggggaatgctgattttg

SEQ ID NO: 15569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgggtttcccgttaagcggacctcgcgc

SEQ ID NO: 15570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggtgcaatcgaccatcgggtttgtggc

SEQ ID NO: 15571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggttccgtcgacgtcaacctactgtgg

SEQ ID NO: 15572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacggttcgggggaaaccatttccgggcgg

SEQ ID NO: 15573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtagctctcacggtgcgggcttttaag

SEQ ID NO: 15574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtccgcatagccgaaggtccgtgtctt

SEQ ID NO: 15575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtcggtgattcggcatcgagaagcatg

SEQ ID NO: 15576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtctccccaaggttcgaacgcctaggc

SEQ ID NO: 15577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtggtggttttggctcgcgtgggcaag

SEQ ID NO: 15578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtgtgcattcgttcctacatgggtcgc

SEQ ID NO: 15579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgtgttccgtttagaccttcatttgccc

SEQ ID NO: 15580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgttccgttgtgcgggtatggccgtctt

SEQ ID NO: 15581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgttgaccgaccggtgtccagtgactgc

SEQ ID NO: 15582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacgttgcgcagcatctgacacggttatac

SEQ ID NO: 15583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactacgacgcggatacagggaattggtca

SEQ ID NO: 15584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactaggtagctattaccattcgcctctgt

SEQ ID NO: 15585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactagttatatcccgcctgggtttctagt

SEQ ID NO: 15586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactatactaatccaatcagagtatagtac

SEQ ID NO: 15587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactcaaagtaccttacactatcttgcgac

SEQ ID NO: 15588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactcaatatcaagtcctgattccccttgc

SEQ ID NO: 15589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactcccgtttcatttggacgtaatggccc

SEQ ID NO: 15590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactcgaaaagttactcgtgttaccgccga

SEQ ID NO: 15591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactgcggtggcggcaggttcgagggcctc

SEQ ID NO: 15592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactgcgtggggtagatgttttgatattat

SEQ ID NO: 15593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactggtgatcgcgacgtttggtcccggat

SEQ ID NO: 15594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactgtggggggggtcgggcaggtaagagc

SEQ ID NO: 15595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagactgtgtaggctcgtcaacgcgtttgggg

SEQ ID NO: 15596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacttagggcaacgtgcggagaccgggttc

SEQ ID NO: 15597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacttatcgagttgctttctccctcgtttc

SEQ ID NO: 15598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagacttatcgcatctctattcatccatgccg

SEQ ID NO: 15599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaaaatatgacacgagccgcgcctttcg

SEQ ID NO: 15600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaagctaactcggtgtcacacatgcgac

SEQ ID NO: 15601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaataaacccagcgcgaaagtacttgca

SEQ ID NO: 15602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaccataccacattcgcgctccgaagtc

SEQ ID NO: 15603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaccctgtgcaaaccttaaggtaccaca

SEQ ID NO: 15604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaccgaggttggcagtgtcacgaaggat

SEQ ID NO: 15605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagacgctaagatttgttgagaccattgcc

SEQ ID NO: 15606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagactgcgattgggagggtctcggggggg

SEQ ID NO: 15607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagacttctccccttctgtcacgtgggacg

SEQ ID NO: 15608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagattcgtagattaaattgacattggg

SEQ ID NO: 15609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagccagatgtgcgggtgtcgggcagct

SEQ ID NO: 15610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagcgccaaggccctaacgctagtacct

SEQ ID NO: 15611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaggccgagcgtcgacccatgcatgccc

SEQ ID NO: 15612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaggcgcaggtcgtaggcgcagtttcgg

SEQ ID NO: 15613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagggactagtgtgcagtcgtgacgccg

SEQ ID NO: 15614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagggagcatggtaaggggcgggggtaa

SEQ ID NO: 15615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagaggtccgtttccggggcgcatgctgca

SEQ ID NO: 15616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagtaaacctgccctacgtgatggcacg

SEQ ID NO: 15617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagtaggcggcagatcaaggcatttatg

SEQ ID NO: 15618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagagtttagctaggaccaaaacaacacaa

SEQ ID NO: 15619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagataaccactgatgcgttagctatatca

SEQ ID NO: 15620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagatcctgggcatactgcgctagttggcc

SEQ ID NO: 15621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagatgcgagccgtaaggtgtccaccttct

SEQ ID NO: 15622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcaaagcgaaagagggtttgagttggcc

SEQ ID NO: 15623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcaaggcccggtgaatggacggcggttg

SEQ ID NO: 15624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcaattggcgaacgggtcgttttacgca

SEQ ID NO: 15625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcagcagaggtctcggttggcagggtgt

SEQ ID NO: 15626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcagcagtgataagccttgtaccgggga

SEQ ID NO: 15627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcagcgccgtatcaccattaatgatgtt

SEQ ID NO: 15628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcagcgtcagaaaagagctgtgggcttc

SEQ ID NO: 15629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcatggacatgggttcggcgtctacctc

SEQ ID NO: 15630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcattaaatttttttctacatcttgcaa

SEQ ID NO: 15631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcatttgatccggaggtcgttatatgga

SEQ ID NO: 15632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcccggttccgctagtctgtactcgttc

SEQ ID NO: 15633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcccgtacttgacgcagccttttcgcct

SEQ ID NO: 15634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcctggtactatcccgcgccgtctgggt

SEQ ID NO: 15635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcgaacacggtgccatgtgcccggccca

SEQ ID NO: 15636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcgagggtagtgcaacgggcgtcctgcg

SEQ ID NO: 15637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcgattcttgaaatcacggtatccggac

SEQ ID NO: 15638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcggacgcaggacccggctttaggttag

SEQ ID NO: 15639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcgggcctgaggctgttctttttaacgg

SEQ ID NO: 15640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcggtgtagtgtccatcttcccacatat

SEQ ID NO: 15641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcggtttgtccaggtcgctgacggtcgg

SEQ ID NO: 15642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcgtggcttgattctcgtccggcattga

SEQ ID NO: 15643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagctaaggttattacagaatagtctgtgg

SEQ ID NO: 15644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagctcggcttgtcgtatgcgtgttacgtg

SEQ ID NO: 15645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagctctggtatccatcggttatccgaggt

SEQ ID NO: 15646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagctcttaacattagatcttgttcttagg

SEQ ID NO: 15647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagctggagctgatgattccgtattttaga

SEQ ID NO: 15648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagcttaacatttcggacgtatgcgttctt

SEQ ID NO: 15649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaaacacgcccgcatgtcatactgggc

SEQ ID NO: 15650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaaactcgcacaagtgccttggtatac

SEQ ID NO: 15651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaacgctgaggttttctttcaagatcg

SEQ ID NO: 15652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaaggcgcccatactttgactcttccc

SEQ ID NO: 15653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaggctgggtgggaactggatgacagc

SEQ ID NO: 15654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggaggtggccttgcgcgagggttggcta

SEQ ID NO: 15655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggagtaggaacgcggtcccttgttcgcc

SEQ ID NO: 15656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggagtgtccgtgtttagccctaggcgcc

SEQ ID NO: 15657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcaaaggttctttatctggcatcgggg

SEQ ID NO: 15658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcacggaatccttggatcgcacctggc

SEQ ID NO: 15659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcagagttccgtgggaggtatcgttcg

SEQ ID NO: 15660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggccgaacgggcgtgcgtgacttcttgt

SEQ ID NO: 15661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcctcgtccagggcgcttagttaatcg

SEQ ID NO: 15662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcgcgttgggaccactatggtaccttg

SEQ ID NO: 15663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggcgtggaagacttcaatgttactccgc

SEQ ID NO: 15664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggctagcattgccaaaatgagtggggca

SEQ ID NO: 15665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggctcgaggacggattccatgtggctaa

SEQ ID NO: 15666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggctgttttgtgtcctaacccatcacca

SEQ ID NO: 15667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggaagcgaagacggttttcggcagcgg

SEQ ID NO: 15668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggaataggggtgcctctactagggtcg

SEQ ID NO: 15669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggactgattacaatcgccactgttgca

SEQ ID NO: 15670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggcagcagtggggactacattgtccta

SEQ ID NO: 15671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggcgtgggggcgtgcgatgcgacgact

SEQ ID NO: 15672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggggatctgaccacggtaaacgcctgta

SEQ ID NO: 15673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggggagacgacgggaccagtgtgcatt

SEQ ID NO: 15674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggtgctttagcggggtgactggtgacg

SEQ ID NO: 15675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggtggaggaaagcactgttgtgcgtcg

SEQ ID NO: 15676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggtggccgattggtggcgggaaacagt

SEQ ID NO: 15677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagggttagcaatgtagcgcgctccggcac

SEQ ID NO: 15678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtagcgcggttgtaactcactacacct

SEQ ID NO: 15679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtccggtcgttagagaatcacgaccca

SEQ ID NO: 15680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtcgagggtgggaagtatggggagtcg

SEQ ID NO: 15681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtgatagtagcaccaccgcgaactcac

SEQ ID NO: 15682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtggagggggttcacattgttttcgca

SEQ ID NO: 15683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtggccggtgtctagagggctgctcgg

SEQ ID NO: 15684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtgtacaggtgatgctaggacgatact

SEQ ID NO: 15685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtgttcttcttaacgtggctgctttcc

SEQ ID NO: 15686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtttacgccggccacctcgataatgcc

SEQ ID NO: 15687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagaggtttggttatgaaggtggtcttcgtgg

SEQ ID NO: 15688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtaacggtaacacacggagcgagatgca

SEQ ID NO: 15689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtaactacgagttcgatacgccaggcaa

SEQ ID NO: 15690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtacgactctcttttgttcgggcctcat

SEQ ID NO: 15691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtacgctggttgggctgagaggtgcgtc

SEQ ID NO: 15692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtactgctctttacttacttttatactc

SEQ ID NO: 15693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtacttgctagcccgttcagaaacgaag

SEQ ID NO: 15694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtatacctgcacatggagttagcgcagc

SEQ ID NO: 15695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtatagggatttccattaagccgcgatt

SEQ ID NO: 15696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtgatggtaaggccgtccaggagggttt

SEQ ID NO: 15697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtgccaggcgaagacggctctatctcgc

SEQ ID NO: 15698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagtgttggtttacttctcccttgattctc

SEQ ID NO: 15699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagttccgccataacgctgcgagttattct

SEQ ID NO: 15700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagttgcgacacttcgtatggtgaaggccc

SEQ ID NO: 15701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagttgttattagctaacacccgcaaacta

SEQ ID NO: 15702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagagttgttcaattcgtggttatccacactg

SEQ ID NO: 15703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagataatgcaacttgctggagactaagcccg

SEQ ID NO: 15704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagataccaattaagcgagacccgtgataggg

SEQ ID NO: 15705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatacgtagcgagaacccgtcgagtcgcgc

SEQ ID NO: 15706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatagatttaaaggtatcacgtgacagtgg

SEQ ID NO: 15707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatagcacttagagaagatattccgttatt

SEQ ID NO: 15708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatagccgattggcagaaaacatttggtac

SEQ ID NO: 15709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagataggagcgtgaagcattgctattccggg

SEQ ID NO: 15710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagataggatcagtgtaagcgaataccccggc

SEQ ID NO: 15711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagataggctcagagttcacaagttcccgggg

SEQ ID NO: 15712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatatagggacagcaatcattcggtatggt

SEQ ID NO: 15713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatatcagggctagttccgacgggttacgc

SEQ ID NO: 15714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatatcgccgtctgtagtaggaagtcttgc

SEQ ID NO: 15715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatatggcgatgaggagctagttctgccgc

SEQ ID NO: 15716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcaaacagcattccggtcgcaagcgcta

SEQ ID NO: 15717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcaagagtgtgtcgtacttagtgcggtc

SEQ ID NO: 15718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcacagtgtcacgcataattccggccca

SEQ ID NO: 15719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcactcggtctggtggcaagcgttccgt

SEQ ID NO: 15720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcagaaagtgccgatttgttaggatacg

SEQ ID NO: 15721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcagctccgccggagctgcgtactgaat

SEQ ID NO: 15722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcaggccgcccttacagcccactgtctt

SEQ ID NO: 15723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcagtcaagacgcatctgatacatgtgg

SEQ ID NO: 15724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcagtttcaggctcttcattgatggtcg

SEQ ID NO: 15725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcataggggttaggatccaccgcggcgg

SEQ ID NO: 15726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcatcgggacggattatactgtcaccgc

SEQ ID NO: 15727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcatgcgcgctctttatccgcggctcgc

SEQ ID NO: 15728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcccgttctgttcgagcgaagttgcgtc

SEQ ID NO: 15729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcccttgtcgttttatctgtgggtgggc

SEQ ID NO: 15730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatccgccacgctcactcgcacgcataagt

SEQ ID NO: 15731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcgagagtgcgacggctttccatcatgc

SEQ ID NO: 15732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatcgcgtcgtgtaggggacgatcctgggg

SEQ ID NO: 15733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatctatccaggtgcatcacgtccctgcgt

SEQ ID NO: 15734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatctctctctgtttacgcgttccgagtat

SEQ ID NO: 15735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatctggtccgaatccgcactaagcaggta

SEQ ID NO: 15736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgaacgctacaggtcgagaactgtgcgg

SEQ ID NO: 15737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgaagggtcctccttgtagatccgcaat

SEQ ID NO: 15738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgacacgcaatgatcctcggaacccgcg

SEQ ID NO: 15739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgacacgtgcgagcgaacgaaaacacgc

SEQ ID NO: 15740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgactagcgtgttctatgtgcttttcaa

SEQ ID NO: 15741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgagtggtagcttccctgacctacacct

SEQ ID NO: 15742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgcctcggccgtcctgggaatctggggt

SEQ ID NO: 15743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgcgggaattcggtggcggtggtggtgc

SEQ ID NO: 15744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgcggtccaaccactgaaagggagcgcg

SEQ ID NO: 15745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggacgccaaggctgacctgaccgaatg

SEQ ID NO: 15746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggaggtgtgtgtgccagtacccatttg

SEQ ID NO: 15747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggagttctataatcgggcagaggtccc

SEQ ID NO: 15748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggcgcaggaggtaggttgatgagcggt

SEQ ID NO: 15749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgggcgatcatagccaggtaccgtggcg

SEQ ID NO: 15750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgggcttactttcccgccaagctatggg

SEQ ID NO: 15751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggggcacaggaatctcagccgattcgc

SEQ ID NO: 15752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgggggtatcgtacaatgcactcggcgg

SEQ ID NO: 15753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggtacggttagatcggcctttttctcc

SEQ ID NO: 15754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggtcaagtggccgacacacggggggtg

SEQ ID NO: 15755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatggttatgaggtggcgctgcaatgggaa

SEQ ID NO: 15756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgtcagggactggtgcactggaggccgt

SEQ ID NO: 15757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgtctgcttccccaggtgcaattttggg

SEQ ID NO: 15758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgttgaccggtagagcgtactggtgctg

SEQ ID NO: 15759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatgtttcttagcgcgtaaggactccctgt

SEQ ID NO: 15760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattaaaaacctcggggagtcctcggatcc

SEQ ID NO: 15761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattacgtgtatggtgctgttgtttcatag

SEQ ID NO: 15762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattagacccttgctatacagatgggtgga

SEQ ID NO: 15763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattagccgagtacagccttaaggtgcggg

SEQ ID NO: 15764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattagcttttcgtcatatctattgcgaat

SEQ ID NO: 15765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattcacgtggttacctcctatttgtgtcg

SEQ ID NO: 15766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattcgtggccccttggaattgcgttggat

SEQ ID NO: 15767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattgcacgggcactaagagtgtggctcgg

SEQ ID NO: 15768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattgcgcttcacgggttgcatgtcgtgca

SEQ ID NO: 15769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattggagcattctaagtaatggtttaccc

SEQ ID NO: 15770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattggcggcaacctgagacttacgttact

SEQ ID NO: 15771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattgggcgtgcgcgctcggaccacgggtc

SEQ ID NO: 15772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattggtgtgcaagtagatagccctctctc

SEQ ID NO: 15773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattgttatctattgtaggcttctttagtc

SEQ ID NO: 15774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatttcgtccttgtttcatgtgactcttgt

SEQ ID NO: 15775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagatttctgtctaacaggctataagggcgac

SEQ ID NO: 15776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagattttaagatcgtggacggtataacaacg

SEQ ID NO: 15777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaaactctaatgctaggtcgtcggcgcc

SEQ ID NO: 15778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaaccctcgtccaacgtggaaggcctgc

SEQ ID NO: 15779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaactcattcccgcgcatgggataagcc

SEQ ID NO: 15780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaagggtgattccggcgacctcgtctga

SEQ ID NO: 15781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaagtcggacacgcgtggattcgttggc

SEQ ID NO: 15782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaagttgggagtattgactacagggagt

SEQ ID NO: 15783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaatggacccggaccagttggtgtgacg

SEQ ID NO: 15784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaatttaccccgcgatcagggtgctacc

SEQ ID NO: 15785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacacagtcggggttagtaccggtagct

SEQ ID NO: 15786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacaggcgttgacaaggatgaagatctg

SEQ ID NO: 15787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacattttcgtattccctcggagtgtct

SEQ ID NO: 15788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacctggaatttcgctcttatgcttcgg

SEQ ID NO: 15789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacggacaaggggcctgtcaccttgaca

SEQ ID NO: 15790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacggcacaacaggggtatcgaccgagg

SEQ ID NO: 15791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaactgatttgttgttcgatttcacgcgc

SEQ ID NO: 15792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaactttcacgcagtagacgttggacatc

SEQ ID NO: 15793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaacttttggtgtgtggaatgccgccttg

SEQ ID NO: 15794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaagaaatggggaatcttcgcgttcatga

SEQ ID NO: 15795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaagacttgatagttcgcctcggcaccgg

SEQ ID NO: 15796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaagcgaaatgccaaggaaagcatgaggt

SEQ ID NO: 15797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaggacccgatttggtatgtaatcagcc

SEQ ID NO: 15798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaggatctgatcaaatcaggtgtgctct

SEQ ID NO: 15799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaaggtcctaagtgactgcacaagttgct

SEQ ID NO: 15800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaagtgatcggatatatgtacccagacat

SEQ ID NO: 15801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaagttcgatgtcgatccagggcatatcc

SEQ ID NO: 15802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaatatggctccgacaggggaaaccgttt

SEQ ID NO: 15803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaatctcgtttggcgcggcgaatggttta

SEQ ID NO: 15804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaatgtgtctcaattatatccaaattttg

SEQ ID NO: 15805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaatgttccacagtctatgtcggccccac

SEQ ID NO: 15806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaatttcgcctcagtagcggtcctgaagc

SEQ ID NO: 15807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacaacttgtatagggtttccacccctgg

SEQ ID NO: 15808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacactaacggcgatctccgtggtaagtg

SEQ ID NO: 15809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacactgcccagactttcgttcttggtca

SEQ ID NO: 15810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacactgcgtgatggtagcggtctgggtc

SEQ ID NO: 15811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacagcagtgtcttcatgccggcggcaag

SEQ ID NO: 15812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacataagtccaggcgctcatccatctat

SEQ ID NO: 15813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaccaataacttatgcagattgatggccc

SEQ ID NO: 15814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacccaggattattgtttggtcccgtacg

SEQ ID NO: 15815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaccccgacgtcgatgtttgatcgttgat

SEQ ID NO: 15816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaccgcgtctattagccctagtggcctcg

SEQ ID NO: 15817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaccgttcgtccttctttcgcgactttgg

SEQ ID NO: 15818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacctggggttttgtaagatgaacaatgc

SEQ ID NO: 15819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaccttgcgaggagaaatacagcatgtaa

SEQ ID NO: 15820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgacgacgcatcttctcgaatcatccg

SEQ ID NO: 15821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgactcattgtgcactgtacgtacccc

SEQ ID NO: 15822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgcgagaaggtgttgtggtagctagag

SEQ ID NO: 15823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgcgattagcgatgatctaggccatgt

SEQ ID NO: 15824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgcgcatcggatacacaatgctctgcg

SEQ ID NO: 15825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgctgttgtaccgcttggtcccttgtc

SEQ ID NO: 15826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacggatatgcgtcacttctgcaaccccg

SEQ ID NO: 15827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacggatgcagacctcgactcggcgaatg

SEQ ID NO: 15828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacggatgtgacagttagtggagccatgc

SEQ ID NO: 15829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacggcaaaaagttaatgaattcccaacg

SEQ ID NO: 15830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacggcctacgttctgtgtagttactccc

SEQ ID NO: 15831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgtcaatcagggggtggtttcatgcct

SEQ ID NO: 15832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcacgttctatggtgcagcgatgcgccggc

SEQ ID NO: 15833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactagaaagaatggcgtctggaggtaac

SEQ ID NO: 15834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactatcaacgttctaacctattctctag

SEQ ID NO: 15835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactcactcatctttccagtacccttgtc

SEQ ID NO: 15836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactcccttgccaagacatttatctactc

SEQ ID NO: 15837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactctagtcttaagccagacggggcggc

SEQ ID NO: 15838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactgtccgaatttggtcgtcacggtcca

SEQ ID NO: 15839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcactgtgtcgggaatgtggctcgttgatg

SEQ ID NO: 15840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagaaccagccatggcagcatttcagtgg

SEQ ID NO: 15841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagaccaggacgcgccgatcagtcgccgt

SEQ ID NO: 15842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagactgtaatgttggcttggggaaagga

SEQ ID NO: 15843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagactgtacgatatagcatgcgaagggg

SEQ ID NO: 15844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagagcaccaaccggctttacacggtggc

SEQ ID NO: 15845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagaggggttcaacgcggaacgaagagtc

SEQ ID NO: 15846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagagttgagatgattcgtaggttcggtt

SEQ ID NO: 15847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagatcgtgattcccggatattccgtgcg

SEQ ID NO: 15848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagatgctgggtgtccgcggtcctgtggg

SEQ ID NO: 15849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagattcctctcactggatgtgcctctgc

SEQ ID NO: 15850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcagccgcactgcagcgtgggttccta

SEQ ID NO: 15851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcccgtggcctcacaccctcgcagcca

SEQ ID NO: 15852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcgaacggtccaggtcttaccgtagga

SEQ ID NO: 15853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcgcctgatgtccttgcaacatcgtcc

SEQ ID NO: 15854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcgcttgcacgagatggcccttgtacg

SEQ ID NO: 15855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcggaccacagccagttactctgaggc

SEQ ID NO: 15856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagctaagcatagatgggtaggtggtctt

SEQ ID NO: 15857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagctctagtagcatccgtactatcgccg

SEQ ID NO: 15858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagctctcgtgtataactttggcgtggag

SEQ ID NO: 15859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcttcggtccaggtaggaatggatggg

SEQ ID NO: 15860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagcttgaccggctaattgggtgtggcct

SEQ ID NO: 15861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaggcacagcgatgggtagccaatagccg

SEQ ID NO: 15862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagggccgcagtctcgggttcccagggat

SEQ ID NO: 15863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagggcgttctcggtgctgagttggtcat

SEQ ID NO: 15864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaggggccgttgtaggtgcacctgaatcg

SEQ ID NO: 15865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagggtgtttgttaagtggcctttctttc

SEQ ID NO: 15866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagggttgtgtatggacgtatcgccagcc

SEQ ID NO: 15867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcaggtgctccggtgttcagaggccgttca

SEQ ID NO: 15868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagtaaaccggggacagccggtggcgcgc

SEQ ID NO: 15869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagtaagcgggggttagtggctggtggat

SEQ ID NO: 15870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagtagcataactgtctttctccccggcg

SEQ ID NO: 15871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagtcatccactcctcggtagtactgcgc

SEQ ID NO: 15872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcagtttaattggccaattcttttcgtcac

SEQ ID NO: 15873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatacgaccgtgtccgatttttccctttg

SEQ ID NO: 15874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatactcgccctgcgataaaaccggtgtc

SEQ ID NO: 15875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatcagcaatagtcgcgacctagcatttg

SEQ ID NO: 15876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatccatattagtcttgtttgcgttcgga

SEQ ID NO: 15877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatcgacagaggaactatttagagactac

SEQ ID NO: 15878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatcgcggggacaggtgcctctggggatt

SEQ ID NO: 15879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatctgacgcgtattgatctgggagtgga

SEQ ID NO: 15880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgaggccctgtggcacgtctctgcgaa

SEQ ID NO: 15881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgcggtataagttttcgcgttctgacc

SEQ ID NO: 15882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgcgtggaccacggggatttttgcatg

SEQ ID NO: 15883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatggagcctaatgcatgattcgatgcgg

SEQ ID NO: 15884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatggcacacccaatgacaagaaaccgag

SEQ ID NO: 15885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgtaattacttggccaatcggaatgtg

SEQ ID NO: 15886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgtagccccggagttctcggaagtgtt

SEQ ID NO: 15887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgtaggacttgtacccccgattgtctg

SEQ ID NO: 15888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgtctggtggctgtcttgtctgcttag

SEQ ID NO: 15889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatgttcaggcggataaatcgtttagacg

SEQ ID NO: 15890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattaacaaccggctaggttcagcggtat

SEQ ID NO: 15891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattcatgggctccatacctccagttctc

SEQ ID NO: 15892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattccctacgttgtgttatcatagtgcg

SEQ ID NO: 15893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattccttaccaggaaggggaacgtgata

SEQ ID NO: 15894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattcgcccaacaactgccttcctagtag

SEQ ID NO: 15895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattgaggggaggcactggagaggtcgcg

SEQ ID NO: 15896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattgcacagatcgaggatattttccttg

SEQ ID NO: 15897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattgtgggcctgtagtcccgttaccgac

SEQ ID NO: 15898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcatttgacgcataacccgtgtccagagcg

SEQ ID NO: 15899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcattttctggtccttctgttcctgacgtc

SEQ ID NO: 15900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaaagaagcttggcgactcgagggcttg

SEQ ID NO: 15901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaaatggcgcgagatgtcccatgcggtg

SEQ ID NO: 15902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaaattcaagtggcacggatagcgcggg

SEQ ID NO: 15903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaacgccgtctggtagagtacaatcatg

SEQ ID NO: 15904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaactacctgtggatgtgcagtattcta

SEQ ID NO: 15905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaactcagggacggcacatggacggcca

SEQ ID NO: 15906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaagatcgaatttggcgcagtatttctg

SEQ ID NO: 15907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaatggaatggtgctggtctgcggggat

SEQ ID NO: 15908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccacacacgctccttcaagcccctttagg

SEQ ID NO: 15909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccacaccagcggttagtgaaacatcgcac

SEQ ID NO: 15910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccacgcgcacgcacgacgcttgagcatgt

SEQ ID NO: 15911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccacggcagaaaggtgaattgctgtaatg

SEQ ID NO: 15912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccacggcagatttcactcacgcgggctgt

SEQ ID NO: 15913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccactaagggaataccatgtgggcagaac

SEQ ID NO: 15914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccactaccaaatacttcttccgtctccct

SEQ ID NO: 15915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccactctcctttctggttgggacattggg

SEQ ID NO: 15916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccactgaaatccgaacatagtcgccatct

SEQ ID NO: 15917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagaaaagcgagttccttgtagagtttg

SEQ ID NO: 15918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagacctcgcaatgtaaatcctagttgg

SEQ ID NO: 15919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagatctttattgtgcgagcagtgtccg

SEQ ID NO: 15920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagccgttccttgcatgcatctagtcac

SEQ ID NO: 15921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagccttgtttgtgggccagctgttctt

SEQ ID NO: 15922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagcttcggcttaacgtcgagtccgcac

SEQ ID NO: 15923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaggatggtcgtcagtaacggagcgtcg

SEQ ID NO: 15924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaggccacatgcgtccgtcaggttatgg

SEQ ID NO: 15925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccaggcggtgccacgtggagtttgattgc

SEQ ID NO: 15926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagggtcgggactaactttattgtgggt

SEQ ID NO: 15927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagttacgcaacgctgagtttggttatc

SEQ ID NO: 15928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccagtttgcgttgacttaagggcgatgta

SEQ ID NO: 15929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccataattcccaagttggctatgtcgggt

SEQ ID NO: 15930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccatacttggcggcgaaacacgcatacga

SEQ ID NO: 15931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccatccaatcctttcactgacgtacgacg

SEQ ID NO: 15932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccatgggaaatcattggttaaagcgccaa

SEQ ID NO: 15933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccatgttgcagttatcacttctgtgtggg

SEQ ID NO: 15934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccattcccggtttttgagccttagagggt

SEQ ID NO: 15935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccatttgctcggccctgttacattctgcc

SEQ ID NO: 15936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccacccgctgcttgtatcgaatgcgtcg

SEQ ID NO: 15937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccacgcgagtatcaggtcaggctacctg

SEQ ID NO: 15938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccactctagctcgagcccaagtttatgg

SEQ ID NO: 15939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccaggcacgtctactaaggatcgtcttt

SEQ ID NO: 15940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccaggcctgcaccactacttgtgtttac

SEQ ID NO: 15941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccaggggatgatggtgggctacgatttg

SEQ ID NO: 15942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccatctccggttcttagcgctatcacac

SEQ ID NO: 15943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccccaaaattcgtctgctttaagacctgg

SEQ ID NO: 15944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccccgagtgctcttagcgtagagattgt

SEQ ID NO: 15945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccccttggggttgttagaaggttggtcg

SEQ ID NO: 15946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccccgtattcccgagtcctcaacatatcc

SEQ ID NO: 15947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccctacctgacagacgtgtctgaggtca

SEQ ID NO: 15948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgacatggatctgtgttccaaacgaac

SEQ ID NO: 15949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgagttgcgttaggggccatgacgggg

SEQ ID NO: 15950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgatacaagacgtgtgggtgcggcccg

SEQ ID NO: 15951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgatcgagatgtgaactagcttggtaa

SEQ ID NO: 15952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgatttccatcccgtcaacagctcgcg

SEQ ID NO: 15953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgcagaatccgcgcggggtaattagac

SEQ ID NO: 15954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccggattactgcactttgctgtttattc

SEQ ID NO: 15955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgggcgttatatggctgagcataccct

SEQ ID NO: 15956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccgggctaaggttcaatttaagcgatat

SEQ ID NO: 15957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccggtcatgcaaggcctcatgcggtgtt

SEQ ID NO: 15958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccctaacttttgatgcgcgtacggtagtt

SEQ ID NO: 15959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccctagagtaaatatgtgcgcatgtgggg

SEQ ID NO: 15960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccctgtgcataaatttatgttggtggagg

SEQ ID NO: 15961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcccttgaaaatttgacacggatacgttca

SEQ ID NO: 15962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgaccatagggccatccttaggtccatt

SEQ ID NO: 15963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgacccggggtagtgtgagcgacacagg

SEQ ID NO: 15964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgacttttcgcggtttcttcattgccat

SEQ ID NO: 15965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgatcggtacgggtcataagtctttccc

SEQ ID NO: 15966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgattgctagtgttagtccctgtgatgg

SEQ ID NO: 15967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgcatcggggcaacgtcgcttgagccgt

SEQ ID NO: 15968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgcccagggtaaatgatacgttaggtag

SEQ ID NO: 15969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgcgcctctgttaagtgatcctacgcct

SEQ ID NO: 15970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgcgtgaatgtggcaatgagccctggac

SEQ ID NO: 15971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggacaactaataggccatagtcagcgc

SEQ ID NO: 15972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggaggacttggtggagcccgtcatcgt

SEQ ID NO: 15973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggccagtcttgggctctacttcgatgc

SEQ ID NO: 15974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgggcggaaaccggggttctcctgtgta

SEQ ID NO: 15975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgggtggttgcaccggcgcacgcggcgg

SEQ ID NO: 15976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgggttcgctttccttcgctggacaccg

SEQ ID NO: 15977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggtatcttggttaggatggagtcgcgt

SEQ ID NO: 15978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggtccacaaaacttgtatacttaggcg

SEQ ID NO: 15979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggtctatcaagtgtgtgtcacggcgcg

SEQ ID NO: 15980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggtgtcttctcgattctagtgactgcg

SEQ ID NO: 15981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggtgtgcaccttatagtttatggtgcg

SEQ ID NO: 15982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccggttcaatgttctaagtactcgctccc

SEQ ID NO: 15983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtagacgttcattagcgtttgctgtag

SEQ ID NO: 15984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtcaacaaggcgtggtacatgtctgcc

SEQ ID NO: 15985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtccaccgctcggcaagagacggagtg

SEQ ID NO: 15986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtccgaggatcgttccataggccgtgg

SEQ ID NO: 15987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtcgacgatttttccaaatatcttgag

SEQ ID NO: 15988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtcgttgcttgcttacatcataggagc

SEQ ID NO: 15989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgtgttcgagtgcgaggctagagcctca

SEQ ID NO: 15990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgttacgggaggatggtggatctagcgg

SEQ ID NO: 15991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccgttgtgataggacttgctgtggtccgg

SEQ ID NO: 15992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctacatcagcacgtaggtatcacggggg

SEQ ID NO: 15993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctacgagtcggcgctgtcactctagcac

SEQ ID NO: 15994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctagccgagtttggagatgacctcaagc

SEQ ID NO: 15995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcccccgataataggtggcattggtac

SEQ ID NO: 15996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctccgtttaggaaagggactgttagcgg

SEQ ID NO: 15997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcctcgcttcggaatcggtccagggag

SEQ ID NO: 15998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcgtacaacggccagcgaaactgcctg

SEQ ID NO: 15999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcgtcccgcgtacggtccacatgcttg

SEQ ID NO: 16000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcgtgtatgtcacagtcgtgttcgagc

SEQ ID NO: 16001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctcgttcacacttcaccacgtgatcagc

SEQ ID NO: 16002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctctcattggcattattcattttgtcac

SEQ ID NO: 16003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctctcttttcactggatctttgcacccc

SEQ ID NO: 16004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctgcatgaaaagctccgagtcattcatt

SEQ ID NO: 16005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctgcccgtactataaaccccgccgtacg

SEQ ID NO: 16006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctgcgtggggcctttatgatgtgcttcc

SEQ ID NO: 16007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctggattgtccacgtgtaccacggaaac

SEQ ID NO: 16008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctggcgacttgactcgacatgtttgggc

SEQ ID NO: 16009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctggcgattgtcgggggtatgcagttaa

SEQ ID NO: 16010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctgggcgaatctgcatggcctagtcctt

SEQ ID NO: 16011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctggtcattgtgaagtcgccaccgggtc

SEQ ID NO: 16012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccttacggaagtgatgagttctctatgaa

SEQ ID NO: 16013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccttcacgttgggatggtttggtctttat

SEQ ID NO: 16014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccttccccttgttggacggatccattgag

SEQ ID NO: 16015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagccttgcgtatgcggtcgtggtcccgagat

SEQ ID NO: 16016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcctttgatcctttagctgtatgggtgcgg

SEQ ID NO: 16017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaaacacggccagtataccttccctcgg

SEQ ID NO: 16018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaaagttagcgtcgggacagcgccgttt

SEQ ID NO: 16019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaaattgcttgattgcggtagacggatg

SEQ ID NO: 16020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaacgcccgtgctgtaggttggggtttc

SEQ ID NO: 16021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaactacccgtcccacgtcgggatgtta

SEQ ID NO: 16022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaagaagtttggatttgtagatagtctg

SEQ ID NO: 16023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaagcaagaaccaattacgtttccgtgt

SEQ ID NO: 16024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaatacggggcgttaattgcggctccac

SEQ ID NO: 16025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaatcaatcggtttattgtaactgcctc

SEQ ID NO: 16026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaatggacaacgtgactgcgtgtggcgg

SEQ ID NO: 16027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgacaatcatctaaacaagatttggctcg

SEQ ID NO: 16028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgacaggctgtgtatcggttttgtatccc

SEQ ID NO: 16029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgacctgacaggtggctatcggccctagc

SEQ ID NO: 16030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaccttccgggttagaccgaacggggag

SEQ ID NO: 16031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgacgaggctatggctcgatgtatctcga

SEQ ID NO: 16032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgacggggggtttcctgattgtgtaggcg

SEQ ID NO: 16033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgactacacgcggttaggaccgggacatg

SEQ ID NO: 16034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagaatgccgtaggggaatcaccgccgc

SEQ ID NO: 16035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagaccgtcggcaagcacatgaccgaac

SEQ ID NO: 16036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagcagtgacacgggtctgcccgtaggc

SEQ ID NO: 16037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagccggggagtacaccctgtattgtcg

SEQ ID NO: 16038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagcggatcactcgttagttagctaaca

SEQ ID NO: 16039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagctaatacgatgggggtgcatgcggc

SEQ ID NO: 16040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagcttgagccattgccgtatgtcgcgg

SEQ ID NO: 16041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgaggggttatactttggtctatggacgc

SEQ ID NO: 16042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgagtcaaaggtaaatcactgtgcgcggg

SEQ ID NO: 16043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatacgatcgattgtgttctggttttcc

SEQ ID NO: 16044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatcgacatatgcagagccgtgtaagtg

SEQ ID NO: 16045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatgaacgtatgtcgcagggacttagct

SEQ ID NO: 16046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatgggggaggtgagacgccagtgtcga

SEQ ID NO: 16047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatggtaacaacacgcgacggggtcgtt

SEQ ID NO: 16048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatggtgccgaacctgatttcttagtta

SEQ ID NO: 16049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatgtgcaccgacggatatcgttaaggt

SEQ ID NO: 16050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgattcaggcgtattaaaacggtccacgt

SEQ ID NO: 16051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatttacgcgtaggtattgtttacggac

SEQ ID NO: 16052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatttatttttagtcgttcgtgcagaga

SEQ ID NO: 16053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgatttggttgattcaaaggataaggttc

SEQ ID NO: 16054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcaaaaggtccatcactttcaccgtatc

SEQ ID NO: 16055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcaagtcccgtactagatccaatgcccg

SEQ ID NO: 16056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcaatcaaatacgtcgttgcagtttttt

SEQ ID NO: 16057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcactcagaattcacgtatgcctcaccc

SEQ ID NO: 16058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcatgttacagcaatccggccagtcttc

SEQ ID NO: 16059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcattcgaaggattgaagcgggacgggg

SEQ ID NO: 16060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcattggtgtatgctggcagcgtggtat

SEQ ID NO: 16061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccaaagctccgtggtaatcctacgcgt

SEQ ID NO: 16062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccaccggaccacgtgcgggccagtccg

SEQ ID NO: 16063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcccttgcgtgtatttttgctgacttgg

SEQ ID NO: 16064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccgaatgcccgctaatcaagtatgcgt

SEQ ID NO: 16065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccggtctctcaaggagattgatgcacg

SEQ ID NO: 16066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccggtgacatcctgcgagatgctcttt

SEQ ID NO: 16067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccgtgaagtcgtaggtagatttgacct

SEQ ID NO: 16068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgccgtgccaggaaccggttgcggttgtg

SEQ ID NO: 16069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcctaagtgtgttttgcaatagctctgc

SEQ ID NO: 16070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcctgaagtctagtcggttaggtcgacc

SEQ ID NO: 16071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgactgctcgagatcagaacgctaatt

SEQ ID NO: 16072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgagattactggctctcagtgtattca

SEQ ID NO: 16073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgaggtatttggaaccgagaagggtga

SEQ ID NO: 16074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgagttgggcgtgtaaccgacgcgttg

SEQ ID NO: 16075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgatttttagactgcataaccgctttc

SEQ ID NO: 16076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgcagctggtcgttttagcattgtcgg

SEQ ID NO: 16077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgcaggtttccggttcgttgaaaattc

SEQ ID NO: 16078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgcgtcccgcgagagcggcgtacgtat

SEQ ID NO: 16079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcggaaatgcacgccgggatatcagcac

SEQ ID NO: 16080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcggaaggcgtgtggtgacctcacggtg

SEQ ID NO: 16081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcggaccggtctggctctgaggggtaac

SEQ ID NO: 16082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcggaggtatgggacgttgacatgcaaa

SEQ ID NO: 16083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcggggtgtaagtaccgttatccgaccg

SEQ ID NO: 16084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgtgtcgacaggtggacatcgtccatt

SEQ ID NO: 16085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcgtttcccaatcccgtaaggtgcatat

SEQ ID NO: 16086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctaggggacgattctggctgcggcgta

SEQ ID NO: 16087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctagggtaccccaactctaaggcctac

SEQ ID NO: 16088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctcaagacgatcccctagtacccgctc

SEQ ID NO: 16089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctcacgtgaagtcatcttcttttccgg

SEQ ID NO: 16090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctcccacgtcacaaatcccgggtcatc

SEQ ID NO: 16091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctcgaacttaattcccttattggcttt

SEQ ID NO: 16092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctcgccccagaatctagctctatccgg

SEQ ID NO: 16093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctgggagcaattgggtaggtcggctaa

SEQ ID NO: 16094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctgggtcgtttccccacgtctagcgcg

SEQ ID NO: 16095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctgggttacatgtctcctcgtggctcg

SEQ ID NO: 16096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctgtttctcgtaatttttatttttgag

SEQ ID NO: 16097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcttaaacaccgcgtcggcatccggttt

SEQ ID NO: 16098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcttactatcgcggctccggagctcctt

SEQ ID NO: 16099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcttattcgatctacgtacggcagcctg

SEQ ID NO: 16100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgcttgggtaatcgtccagcaaataaaca

SEQ ID NO: 16101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgctttatcataatcaaacttctcgtgtc

SEQ ID NO: 16102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggaagcgcgattcccggggttccctgga

SEQ ID NO: 16103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggaatgcggtactcaacgcgcctgaatt

SEQ ID NO: 16104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggacaatcaactgcatcgttggcggtgc

SEQ ID NO: 16105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggactcgggcacattgccatactggcgt

SEQ ID NO: 16106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggagcaccaggctttgttctcacgtcac

SEQ ID NO: 16107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggagcgtgcgtgactacactggagcagc

SEQ ID NO: 16108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggaggaagtggtgcgatcagggccgggc

SEQ ID NO: 16109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggaggccgtagggggttcagttgtaggg

SEQ ID NO: 16110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggatactagcaccgcacaacttaggcat

SEQ ID NO: 16111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggatatagaacgaaagtttgtttctttg

SEQ ID NO: 16112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggatgaggagttggcttggtagtgtccg

SEQ ID NO: 16113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggattaaaagggccgttctcccttctgg

SEQ ID NO: 16114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcaattcctaacaattggtagtctgca

SEQ ID NO: 16115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcacggcaggatgttctagcgcgatcg

SEQ ID NO: 16116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggccacggcgctgtgaccttccaccagg

SEQ ID NO: 16117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcccgcgcgttcaagcgtccatcggct

SEQ ID NO: 16118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcctgacggacaagtatagttttcaca

SEQ ID NO: 16119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcggaacaatgcggctctctatttgcg

SEQ ID NO: 16120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggcggcattcacttggtgttgggcttcg

SEQ ID NO: 16121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggctgacgcgggggagttgcttgctgac

SEQ ID NO: 16122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggctggcggtaccgatgtcagtggctgg

SEQ ID NO: 16123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggaaaaggttaggtgcgtgtgaacccg

SEQ ID NO: 16124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggatcggtgtttgtatggaataggccg

SEQ ID NO: 16125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggcacttcaggttgcaaataagcgtgt

SEQ ID NO: 16126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggcgcggtcgagatggtatggtacgcg

SEQ ID NO: 16127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggcggcactaatttcgttgctgtattc

SEQ ID NO: 16128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggggtcagtgtttaacctacgcagtgc

SEQ ID NO: 16129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggggtaatacgtcctttcggcggccctg

SEQ ID NO: 16130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggggttcggatttagctcgctaacgcgc

SEQ ID NO: 16131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggtggacaaatttgctacaggcctcgg

SEQ ID NO: 16132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggtgtatacagaacgagaagtcatggc

SEQ ID NO: 16133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgggtttgaattcacggttacatctcttg

SEQ ID NO: 16134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtaggccaggacaaagcagttagttgg

SEQ ID NO: 16135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtctacaagaagttagcctttactact

SEQ ID NO: 16136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtctcggtcgatgcccttgggtcatgt

SEQ ID NO: 16137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtctgcatcgatctaccacccacgtag

SEQ ID NO: 16138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtgaatctccaaggtgggccgaagggt

SEQ ID NO: 16139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtgccaagcgggagggctgatcgctgt

SEQ ID NO: 16140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggtgctaggcaaatcgaccctctcccgg

SEQ ID NO: 16141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcggttgaggggtttaacctagggaaaaag

SEQ ID NO: 16142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtaaatgctttacttccgggtcccctta

SEQ ID NO: 16143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtacacaatttccttgacttgagcaggt

SEQ ID NO: 16144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtaccatcataggtcggggattgcgttc

SEQ ID NO: 16145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtaggcactttgaggccgactgagtggg

SEQ ID NO: 16146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtatcctcattgcctcttgcgtagggcc

SEQ ID NO: 16147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtattgaaccggaatcggcccgcactgc

SEQ ID NO: 16148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtcagggggtagaggggggggtggcgga

SEQ ID NO: 16149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtccgtagagtattaggcgtcgaccggt

SEQ ID NO: 16150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtcgtccggcatgaagacttagaggttc

SEQ ID NO: 16151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtctgccagtcaagctttgtacattcct

SEQ ID NO: 16152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtcttagacttcataggatcgcccgttc

SEQ ID NO: 16153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtcttcgattcacgggctcctggatccg

SEQ ID NO: 16154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtcttgcgatgtggcgggctggattttc

SEQ ID NO: 16155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtctttgaagtgtgtaggtagacgtctc

SEQ ID NO: 16156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgagtaagcccgataggacaaaacgcc

SEQ ID NO: 16157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgattaacctttattcccgcagtgcac

SEQ ID NO: 16158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgcagatttgggggaaatgtgtgcacc

SEQ ID NO: 16159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgccaggagggcagatatccgggagac

SEQ ID NO: 16160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtggaagggggaatctgcggctagcgtg

SEQ ID NO: 16161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtggcaggagcaggtatgctactcccgg

SEQ ID NO: 16162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtggcgtctttagagagatgatcggcaa

SEQ ID NO: 16163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgggggaactgttcctgaggacgcggg

SEQ ID NO: 16164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtggggtatggctcggcacagcaggtgg

SEQ ID NO: 16165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgtaaccaggtgtaccgggtcagcaat

SEQ ID NO: 16166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgttcggtcggtgtgattcttctgtgt

SEQ ID NO: 16167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgtgttttgcaaaggtaattagtaccact

SEQ ID NO: 16168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttatcctcccatcgactggagtacggc

SEQ ID NO: 16169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttcccggctctaacttatagtggtttg

SEQ ID NO: 16170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttcgaggtttgctggatgtggtagcct

SEQ ID NO: 16171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttgacacctcccatcagtctcgcactc

SEQ ID NO: 16172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttgcttcagcaccgaaggtaggggaag

SEQ ID NO: 16173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttggagcgacttgatacttcacacggg

SEQ ID NO: 16174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttggctctggggtgaaggctcggcgat

SEQ ID NO: 16175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcgttgggggggcgtgctcactttgctggc

SEQ ID NO: 16176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaaaaatcgttaagatcaggcgagtgtg

SEQ ID NO: 16177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaaatacacgttgtgttggagttgcttt

SEQ ID NO: 16178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaaatctccttatgcttttggcccgtcc

SEQ ID NO: 16179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaagagtgtgaaccaggttcacgggtgt

SEQ ID NO: 16180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaagcatcgattgtaatacctttaagtt

SEQ ID NO: 16181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctacagtactcaaccgttgcagcagtttt

SEQ ID NO: 16182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctactccgcatagtacttcttatttttac

SEQ ID NO: 16183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctactggtacacggcagaatgggtgatta

SEQ ID NO: 16184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctacttcctaggtccccgactccctgatt

SEQ ID NO: 16185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctagcgtcacgaaactcttatacttggac

SEQ ID NO: 16186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaggcaaactaggcacaatgggaggtgg

SEQ ID NO: 16187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctaggcccattggaaacgggttaactttg

SEQ ID NO: 16188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctatcagggtttacaacgtttacaccgac

SEQ ID NO: 16189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcaaggaaatggaaggtacagcggacat

SEQ ID NO: 16190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcactcgagaccgtttagggtctatcgg

SEQ ID NO: 16191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcatattagcttaatttacttgcgtgtt

SEQ ID NO: 16192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcccggaccaaatgggggtagttcttgg

SEQ ID NO: 16193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctccgggtgttattaggcggcgttgtctt

SEQ ID NO: 16194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctccggtctcgtcggcaattcggctacgg

SEQ ID NO: 16195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctccgtccagtgcagtctggtcagtcacc

SEQ ID NO: 16196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcctgcgcatattaagtcccccccagtg

SEQ ID NO: 16197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgaacacgccctaagccaatgctcacg

SEQ ID NO: 16198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgaaggttcatttgaaccgatcgaggc

SEQ ID NO: 16199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgacccgagttttcgacggttgcgtac

SEQ ID NO: 16200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgatcggcacctttcatcgggggcttt

SEQ ID NO: 16201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgatctagaagggtgtagtgccgtttg

SEQ ID NO: 16202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgccggtcagcaatggcataggggccg

SEQ ID NO: 16203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcggctcccggagctattacccttcagc

SEQ ID NO: 16204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctcgtaatctgttaatccggccttacgtc

SEQ ID NO: 16205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctctccgatacgtcaactgctgttgtaag

SEQ ID NO: 16206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctctcctaaaaaggaagaggcggacaatg

SEQ ID NO: 16207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctctgcaaacttctcttcaggcatcgatc

SEQ ID NO: 16208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctctgcggcgtctggttacagagtcacta

SEQ ID NO: 16209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgaaattgaggggaattgtcggaccttg

SEQ ID NO: 16210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgaaggtgtagtctcgagtccgtttcgc

SEQ ID NO: 16211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgaagttattcgttagctcgatgataag

SEQ ID NO: 16212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgaataggaccattgtgtttgagtttta

SEQ ID NO: 16213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgacgaatcctggacctctgcctaacgg

SEQ ID NO: 16214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgacgctaaaccgaaggagggatgtcac

SEQ ID NO: 16215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgatataggacctgcagcatggttgtat

SEQ ID NO: 16216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgatcccgtgtcagactccctcagatcc

SEQ ID NO: 16217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgcacaagctgtcggacatttgaattcc

SEQ ID NO: 16218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgcatcttttacgccacacggtctgtgg

SEQ ID NO: 16219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgccggtgttgcatttctcaggcgagtt

SEQ ID NO: 16220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgcgagagcagtgggtctgatcattcat

SEQ ID NO: 16221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgcggcttttgtccacaccttgaaaggc

SEQ ID NO: 16222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgctggttactgtatataggtcggcttc

SEQ ID NO: 16223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgctggttgttactggtaccttgcggat

SEQ ID NO: 16224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctggctcctctttggtcctcgcctcagtc

SEQ ID NO: 16225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctggctctcgtaatgtggctccggccggt

SEQ ID NO: 16226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgggagacgataatgtttgcgtccgggt

SEQ ID NO: 16227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgggatgtatcctgctaacgtgccgaac

SEQ ID NO: 16228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgggggatgagttcttgtcgtacggccg

SEQ ID NO: 16229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctggtcacggccgcattgtacccggagtg

SEQ ID NO: 16230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgtatagcgaggtgatcgcgcattattg

SEQ ID NO: 16231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgtattaagcatacacgcgattctcctg

SEQ ID NO: 16232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgtcgcattcagactcactaggggccac

SEQ ID NO: 16233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgtctacacactcccattctgggacagg

SEQ ID NO: 16234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgtgactccatggctgttggtttccgta

SEQ ID NO: 16235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctgttttgtcatccggctcttaacgcctc

SEQ ID NO: 16236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttaacttcaagccgacttaggtgcttca

SEQ ID NO: 16237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttaccgggaacattgtggtctgattctg

SEQ ID NO: 16238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttacctcgcaacgatgacggctgggtac

SEQ ID NO: 16239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttagtgtgctcatacgacgtcggccaga

SEQ ID NO: 16240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttccctcatccatcaagtatctcgcggg

SEQ ID NO: 16241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttcgagtccgcatcagtagatacggtat

SEQ ID NO: 16242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttcggcgtacccgggaaatgttccagat

SEQ ID NO: 16243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttctggccaccggaggctcgttcgactt

SEQ ID NO: 16244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttgccggtggacaccgtatgcggacctc

SEQ ID NO: 16245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttggaacggacgtattcaggttctctac

SEQ ID NO: 16246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttggaagtatcttgtcgaggtaagcttc

SEQ ID NO: 16247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttggggggacgctctttgcggaactaag

SEQ ID NO: 16248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttgtgtcacgcaggcaatctatcccagt

SEQ ID NO: 16249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttgttagtcgatgcactcgagtagtgtg

SEQ ID NO: 16250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttgttgacgacaacttcccagcggctat

SEQ ID NO: 16251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttaaaaggggtaacccatatgagggcg

SEQ ID NO: 16252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttaccggtgcggggaattggcactctc

SEQ ID NO: 16253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttgcaacatgatattaaccgctctggg

SEQ ID NO: 16254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttgccgttctgtgcacttgtggggcgc

SEQ ID NO: 16255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttgcggcgttctctgggtctgatctcg

SEQ ID NO: 16256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagctttggattagggagcgggctggtgcttc

SEQ ID NO: 16257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagcttttcttcccgggaggcattggctgtaa

SEQ ID NO: 16258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaaagggcatacagatctgaaccgtttt

SEQ ID NO: 16259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaacaacttccgggacagtaataccccc

SEQ ID NO: 16260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaaccatagggaaccttggtaggcccct

SEQ ID NO: 16261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaaccctctttcttgaatccggggtatg

SEQ ID NO: 16262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaatggtacgaagcgcaagtgccagcat

SEQ ID NO: 16263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaacaagggcagcgaggcacacacccaac

SEQ ID NO: 16264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaacgaggcgattggacttttcgcttaca

SEQ ID NO: 16265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaacgcgtacacctgtatcgaaaatcccg

SEQ ID NO: 16266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaacgttgtttatactgcaatggcagcac

SEQ ID NO: 16267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaagattagaggaggcgttgtgggccggc

SEQ ID NO: 16268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaagcaccctgattcgggcagttatctaa

SEQ ID NO: 16269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaagccccgggctatcgattgtagcttta

SEQ ID NO: 16270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaagcgtgaacaccaaagtctccgcggcg

SEQ ID NO: 16271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaggacgttacgtgcgtacgaactttag

SEQ ID NO: 16272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaaggggaagcggtgaacattcggggaac

SEQ ID NO: 16273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaatctcatctactgggccgtaccaaact

SEQ ID NO: 16274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaatctgatcagatcgttacagcgataac

SEQ ID NO: 16275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaatgattgttcacgccttgattaccctc

SEQ ID NO: 16276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaatggtctccatacaggcgttgacgctg

SEQ ID NO: 16277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaattagcaacagatagtcagctagtccg

SEQ ID NO: 16278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaattaggcatccagtcgggccaaacagc

SEQ ID NO: 16279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacaaggttaatgggcaaacatttctgct

SEQ ID NO: 16280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacacagcatcttagcaaaaagtagtgtc

SEQ ID NO: 16281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacaccgaatcggcttgcagatacgaaac

SEQ ID NO: 16282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacacgctacgatcgaaaggcaccctggg

SEQ ID NO: 16283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacatgtacgggtcagagaatgacggcaa

SEQ ID NO: 16284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacattcacgctcgtgcatctgctgtcgt

SEQ ID NO: 16285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaccaacataaagggcgctacaaaatgcg

SEQ ID NO: 16286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaccacggacggtgtttttcttactctag

SEQ ID NO: 16287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaccgtaccccgagagtttccagggcact

SEQ ID NO: 16288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacctccggatgtttgcctggcagaatga

SEQ ID NO: 16289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacgacgcggaggccaagtcatcgcaccc

SEQ ID NO: 16290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacggttcgggcacaggtcccgttgggat

SEQ ID NO: 16291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacgtgtaacgggggaaggggtggtttcc

SEQ ID NO: 16292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggactccttcctaatcccatttttggaccg

SEQ ID NO: 16293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggactggtggatcagccgccctcggaggat

SEQ ID NO: 16294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacttactgttgtagttaagcatttaggg

SEQ ID NO: 16295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggacttgtacggttggatctgactgcttat

SEQ ID NO: 16296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagactccattagttggttgcgttgttct

SEQ ID NO: 16297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagagacgagacccgtgtgatcttgcgga

SEQ ID NO: 16298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagatgtgtcgtcagcttcgctaaaccgt

SEQ ID NO: 16299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagattattgcaccctatctatacacagt

SEQ ID NO: 16300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagattggaaaggtctaaggtaggagtta

SEQ ID NO: 16301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagcacggcgtacgtaacgtggtggggcc

SEQ ID NO: 16302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagccaattgggacttccagttctgtacg

SEQ ID NO: 16303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagccccataagcagcccaggcgcagggg

SEQ ID NO: 16304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagcgcgattaatagcgggcggaatgtcg

SEQ ID NO: 16305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagcgcggcattttttttgggcgcacgga

SEQ ID NO: 16306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagcttaggaggcgttgttacgtctgccc

SEQ ID NO: 16307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggattccctctatgtgaaggcaaccgc

SEQ ID NO: 16308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggcatatcatgcatcatcttgccagaa

SEQ ID NO: 16309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggcttattgcagggctaccgggctgca

SEQ ID NO: 16310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagggaatacgctcctcccgttgcactct

SEQ ID NO: 16311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggggtttgatgtagactggcacgtgcg

SEQ ID NO: 16312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagggtcacctttagcccctgggtggatg

SEQ ID NO: 16313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagggttgaccgtcggcagacggctctac

SEQ ID NO: 16314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggtccgctaagatctgtgtcaaaggtt

SEQ ID NO: 16315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggtcgtgacaacatcgccgaaatcttg

SEQ ID NO: 16316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggtgacaacatcgccgttagagccgac

SEQ ID NO: 16317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggaggtgctttgacgttcgggctcggcata

SEQ ID NO: 16318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtagtcaggcacgtcacgtctcggtgc

SEQ ID NO: 16319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtccgagtcgtggccgggaatttgacc

SEQ ID NO: 16320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtccggactcgggaggcttcgtggctt

SEQ ID NO: 16321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtcgctgccgggcaaacgccatgactc

SEQ ID NO: 16322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtgaaccgtttagtcattgcgggtttg

SEQ ID NO: 16323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggagtggaagaatgtctaacgctgaatccc

SEQ ID NO: 16324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggataccccagcacacttcgcttaaacgca

SEQ ID NO: 16325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggataccgttaccaacaagggggtgggggg

SEQ ID NO: 16326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatacctgggcgatggactcgaaggtgag

SEQ ID NO: 16327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatacgttgaccccctcttcaactcggct

SEQ ID NO: 16328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatactactttgtttttcggcattccatg

SEQ ID NO: 16329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatactggtcgagtaaggtgctgttaggg

SEQ ID NO: 16330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatactgtatggcttgtatcgacatgcac

SEQ ID NO: 16331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatagacctatattggatgttcccatggt

SEQ ID NO: 16332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatatggcggccatcacggatatccccat

SEQ ID NO: 16333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatattgcgggtatggtgcgaccttctgg

SEQ ID NO: 16334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatcaacactgacttactctgcgagccta

SEQ ID NO: 16335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatcaccaacctcacaaacaatgtgctcg

SEQ ID NO: 16336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatcactgagtgccttccgacgaccgttc

SEQ ID NO: 16337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatcaggctcgcgggtacacgggcttacc

SEQ ID NO: 16338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatccggagcactagttatctggttgcgt

SEQ ID NO: 16339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatccgtacactggggtatgttgggtgtc

SEQ ID NO: 16340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatcggtggaatgccaccgtacgggacgc

SEQ ID NO: 16341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatctagtgtcgagttgatcttcttatcg

SEQ ID NO: 16342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgactggcaggcgcgcccatagatggg

SEQ ID NO: 16343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgacttaagttggtcgagcacatgtca

SEQ ID NO: 16344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatggacggatctcagagtttgagtctct

SEQ ID NO: 16345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgggggtgctccgtctgttggggccat

SEQ ID NO: 16346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatggtgtcctcgcatgaagaatgcccac

SEQ ID NO: 16347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgtaggcgctcaatacattagccacgg

SEQ ID NO: 16348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgtatagcaccaattaggtaactcatc

SEQ ID NO: 16349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgtgaagaaaggcttaacgccaggcat

SEQ ID NO: 16350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgttagctgcttcacgtgtatggtttt

SEQ ID NO: 16351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatgttatgttattgcgtatattcattgc

SEQ ID NO: 16352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggattagaaaatggttccgtagtaacggac

SEQ ID NO: 16353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggattcaacagggcacgtcctttcgcgtag

SEQ ID NO: 16354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggattcctctcgatctttcacgtctgcctg

SEQ ID NO: 16355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggatttcgatcattactcgtggaggcccat

SEQ ID NO: 16356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaacactgcgcgagaaagaggggagggc

SEQ ID NO: 16357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaacatgatcaacaagcgcggcacgatc

SEQ ID NO: 16358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaagcggtgggacactagggattagggg

SEQ ID NO: 16359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaatgtggcattgagcaggattcgtgcg

SEQ ID NO: 16360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaattatttgcttagccgggcgtattgt

SEQ ID NO: 16361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacaactagtgtacaatgaggcacggca

SEQ ID NO: 16362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacactccactgcgccgaactggatgca

SEQ ID NO: 16363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaccatcaataagtgcgacattgaccgc

SEQ ID NO: 16364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacgattctgagtcgggggaaacgggct

SEQ ID NO: 16365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacgcagggtttgcttgacgtggctcgg

SEQ ID NO: 16366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacggggttctttgcggcttggcaataa

SEQ ID NO: 16367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcacggtaggcgagctcaccactttgcca

SEQ ID NO: 16368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcactgttgacatacccgcgcgtgggctc

SEQ ID NO: 16369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagagtagggagaatgtccgtgatcagg

SEQ ID NO: 16370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagatcaactcagggcaggggtttctgc

SEQ ID NO: 16371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagcagacgccggtatggccttagcgag

SEQ ID NO: 16372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagcagcatcgtttatccgctttttgga

SEQ ID NO: 16373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaggcgtaataagatgtggatcgcatag

SEQ ID NO: 16374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcaggcgttcgctacggttaaggacgggg

SEQ ID NO: 16375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagggacgtctgcaaaaacggttggggg

SEQ ID NO: 16376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagggtcagtggacagggactggggctc

SEQ ID NO: 16377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagtcacatggcgaagtacctgtgaatc

SEQ ID NO: 16378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagttatagcgaattcaccgtgtagagc

SEQ ID NO: 16379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcagtttaggtggggatccaccgcatgac

SEQ ID NO: 16380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatagttgaacgatgagtttgtcttggt

SEQ ID NO: 16381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatatgaccacttattatatcgcgatag

SEQ ID NO: 16382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatcatagccaaggtcgccgatcgtgtc

SEQ ID NO: 16383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatccgtaatcggacattcctctagagg

SEQ ID NO: 16384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatcgaaatagcgcaattgtagtggctc

SEQ ID NO: 16385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatcggtagcactgaggcccacatggag

SEQ ID NO: 16386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatctgcggaacattggggtaccacctc

SEQ ID NO: 16387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcatgccggacagtatagagaagtacccg

SEQ ID NO: 16388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccaatagcgaacagttgctgggtagttg

SEQ ID NO: 16389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccacgggttgcgggacctatggtttgtt

SEQ ID NO: 16390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccactggtccagcgggtacgagtgaata

SEQ ID NO: 16391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccaggagctaattccttccaccagctgc

SEQ ID NO: 16392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccaggccgcacggacggtcgaagccatt

SEQ ID NO: 16393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccagttctccctagggtttgccacttac

SEQ ID NO: 16394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccatccctatatggtgcgagtcggattt

SEQ ID NO: 16395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccatccgccacaaccgatgcgaaggtct

SEQ ID NO: 16396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccatcgagcggtttctcctcactcagtg

SEQ ID NO: 16397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccattcgtctcatatacgaagtcgcacg

SEQ ID NO: 16398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccattctaggaattcttgtacagggtgg

SEQ ID NO: 16399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcccatacgtcatacccgtaccaggctga

SEQ ID NO: 16400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccccagtgagtgggtgagccatgaaggt

SEQ ID NO: 16401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcccgaggccatatctaaggccccgggtc

SEQ ID NO: 16402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcccgttgagccgtgcatccagacaagcg

SEQ ID NO: 16403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccctacggctttagcggtagtcagaggt

SEQ ID NO: 16404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccgacgtgtttcttcgccagtttcgccg

SEQ ID NO: 16405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccggcatcatgtcggaggactggttgca

SEQ ID NO: 16406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccggcgtatgtgttatttcggactgaaa

SEQ ID NO: 16407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccggtagcgggcaaacgctctacagtgg

SEQ ID NO: 16408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccgtatattttggctgtcataaatctgc

SEQ ID NO: 16409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccgtggagtgcattttgcggaagtgagt

SEQ ID NO: 16410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcctaggccggtattcgcggaggtcacga

SEQ ID NO: 16411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcctataattttatttaggaccgagaatt

SEQ ID NO: 16412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcctcaccgtgaacgcatagcagacgacg

SEQ ID NO: 16413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcctggacggaattaaacattgtatccgg

SEQ ID NO: 16414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggccttcaggctaggtaccatgttaggctt

SEQ ID NO: 16415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgacatcgctaagattgttgggggtggt

SEQ ID NO: 16416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgacgtcgagaatttatgttactacgag

SEQ ID NO: 16417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgagaaacgagcaatgatcacgagggcc

SEQ ID NO: 16418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgagcatgggtcgaagcgaggggttgat

SEQ ID NO: 16419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgatagttgggtatatcagtgtgaactg

SEQ ID NO: 16420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgatggtaaagaagacgtcgctctcctg

SEQ ID NO: 16421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcaaactgtaggggacctagctttctg

SEQ ID NO: 16422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcaagggatattaagtagctagtgttg

SEQ ID NO: 16423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcagcagattaatgccgcaagcaggtt

SEQ ID NO: 16424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgccatcctcgtccctggtccccactgc

SEQ ID NO: 16425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgccgtcctgtgagcaattgcacgctgt

SEQ ID NO: 16426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcgaaatagggccatggagttagctgg

SEQ ID NO: 16427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcgagggtcatctcgaattgagggagg

SEQ ID NO: 16428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgcgggccaaatgacgactcgaatgtcg

SEQ ID NO: 16429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgctcgggagggatatgacagagttggg

SEQ ID NO: 16430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggacggaaagggccggcgtgaatgctt

SEQ ID NO: 16431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggatcatcgactcacgcacgtttcccg

SEQ ID NO: 16432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggcccttcgtcaacgtcctcagcataa

SEQ ID NO: 16433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggccgtggatctttctaccgttggtcg

SEQ ID NO: 16434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggcgggttttatatgttgggacagaat

SEQ ID NO: 16435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgggagcgtggtaagtgtttgatctcac

SEQ ID NO: 16436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgggcggtctaggggcaaaggcggagtg

SEQ ID NO: 16437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggggaacagcctcttggtcggggctcg

SEQ ID NO: 16438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggggactggtagtttattaattcatct

SEQ ID NO: 16439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgggggctaggctattgcaaactcgctg

SEQ ID NO: 16440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgggggtggagagagaccgttacgggtt

SEQ ID NO: 16441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggtatccaggagtggcgtgacaggggc

SEQ ID NO: 16442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggtcattcgttcgaaatgcgtggggga

SEQ ID NO: 16443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggtccccaattgtctagcccgatgagg

SEQ ID NO: 16444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggtctgggcaggaggtttcggagcctc

SEQ ID NO: 16445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcggtggttatgtttcaatccatcatggc

SEQ ID NO: 16446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgtacgcgaaggcggttaggcagttagc

SEQ ID NO: 16447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgtcttactgcaatgtcagacagcgcgt

SEQ ID NO: 16448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgtggggcgcgcacactcactgcggtcg

SEQ ID NO: 16449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcgttgcaaggccatacgtttggggccgg

SEQ ID NO: 16450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctaacgggcgaggtcctcccacctgctt

SEQ ID NO: 16451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctaccccggcttcatccggttccaaatg

SEQ ID NO: 16452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctaccggtgggatccttcagctacctcg

SEQ ID NO: 16453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctaccttaactaggagcgcgcctccttt

SEQ ID NO: 16454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctacggcacgatccgtccatgctaaccc

SEQ ID NO: 16455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctagttcgcttaaagtttgcagcagcgt

SEQ ID NO: 16456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctatgcgcaggtgtatcatcttaacggg

SEQ ID NO: 16457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcactctgccaagtacgggaaggtctg

SEQ ID NO: 16458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcataggatgtaagggatagaactggc

SEQ ID NO: 16459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcatcttgttcagggggagttgcgtgt

SEQ ID NO: 16460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcgaaccgacgtgagaaaagagtgacg

SEQ ID NO: 16461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcgaacgatgacagacgctggacgccc

SEQ ID NO: 16462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcgcgacacccaacgtaccttgtggat

SEQ ID NO: 16463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcgttccgtttctaatatgctttgtca

SEQ ID NO: 16464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctctacatctcaggaatgcgatctcgtc

SEQ ID NO: 16465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctctcgggattgatgcagcgttgcttcg

SEQ ID NO: 16466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctcttagtccgacgcgttatctgatgac

SEQ ID NO: 16467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgatactatcgtcgaccccgatcatgc

SEQ ID NO: 16468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgatccgccgtcaccagtggcgccaat

SEQ ID NO: 16469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgccgcaatgcatgacagcacgtatgg

SEQ ID NO: 16470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgctgtccctccatacggctatctacg

SEQ ID NO: 16471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctggagagccccatgtactctcatgggc

SEQ ID NO: 16472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgtcttgaagccacaatgtgtgtccat

SEQ ID NO: 16473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgtggcaaagggtgtggttcattgttg

SEQ ID NO: 16474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctgtttcggcgaaatcgcgaacacttac

SEQ ID NO: 16475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttaagaccagaacctgtcatggggccg

SEQ ID NO: 16476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttacgcgcaagctggaatgttcaccat

SEQ ID NO: 16477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttaggagacagaagactcgggtccatc

SEQ ID NO: 16478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttccaatgcaacggctcccccaggcgc

SEQ ID NO: 16479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttcccaaaccagcacgttatttcactc

SEQ ID NO: 16480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttctctcgggtttactttgcatttgga

SEQ ID NO: 16481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttggccggcggaaaagggcaccaggtg

SEQ ID NO: 16482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggcttgtattcaatgcgggacacaccccct

SEQ ID NO: 16483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctttcattctgtcgtctcgcggatcata

SEQ ID NO: 16484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctttcctgtggatggggggtgctagcat

SEQ ID NO: 16485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggctttgaacgcgtggatcctgtttacgaa

SEQ ID NO: 16486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaaataaaagagggtgacaacagttaac

SEQ ID NO: 16487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaaatccctcccagaaatttaaagccaa

SEQ ID NO: 16488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaactgtgtgagcccgggctagacggcg

SEQ ID NO: 16489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaagtcatggttaataagttttacatcg

SEQ ID NO: 16490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaagtcggttaaaggttgatttggtctg

SEQ ID NO: 16491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaatcttatagtaatgatcagcttatta

SEQ ID NO: 16492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggacattacgtatggctcactttcggccc

SEQ ID NO: 16493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaccggagtagttctttagtcaccgcgg

SEQ ID NO: 16494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaccggtgcgttagtggacagcaacgcc

SEQ ID NO: 16495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggacctcccttacgatccgtgcgtactgt

SEQ ID NO: 16496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggacgcatgcaccgtatgttattgtggcc

SEQ ID NO: 16497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggacgttcgtacaacatgctttgtgcggc

SEQ ID NO: 16498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagactatgcatcatccgtttctgttac

SEQ ID NO: 16499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagagggtgtgtggtacatgcgtggccg

SEQ ID NO: 16500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagagggttgtttatcgccgaccagtaa

SEQ ID NO: 16501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagcatcatccgaacgtggggattttgt

SEQ ID NO: 16502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagcccgggaatgcatcggtcgtctatt

SEQ ID NO: 16503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagcctttgaggcaacgcggctcgggtg

SEQ ID NO: 16504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagcgcgagttgttctcatacgatagtg

SEQ ID NO: 16505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagcgtcgcgttgcacgtataggttcat

SEQ ID NO: 16506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaggccaaatgcctcacacgcttcgcgg

SEQ ID NO: 16507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaggctgggctagaggcaggagtatcgg

SEQ ID NO: 16508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagggacgtgccggccggtaatacgtat

SEQ ID NO: 16509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagggcttcgacgttctgtcatcacctc

SEQ ID NO: 16510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggaggtgcgggcaattgactgcattcgcg

SEQ ID NO: 16511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggagtttacgcgggaggcggtaagttgcg

SEQ ID NO: 16512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatagttacgtatgccaatgtataaacg

SEQ ID NO: 16513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatcagtcgggaacttgatctgtggtcc

SEQ ID NO: 16514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatcgccattattcctgttcaccacgct

SEQ ID NO: 16515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatctccaatcgagcgagagctgtaggc

SEQ ID NO: 16516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatgatgaatctagtgtatttcctcgct

SEQ ID NO: 16517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggatgggcagcaaccggggcagttgagcg

SEQ ID NO: 16518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcaacctcctctggggccatgaggcatt

SEQ ID NO: 16519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcaagtgtgcacgttcccatcgctcaac

SEQ ID NO: 16520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcacctctcggaattatgggttatgtga

SEQ ID NO: 16521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcagaactcagacacgagcaatcggcac

SEQ ID NO: 16522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcaggttctcccactggctttgcgctcg

SEQ ID NO: 16523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcagtgggaagggttaagaagtcaagcg

SEQ ID NO: 16524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcatccggcagcatgacagctttttttg

SEQ ID NO: 16525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggccatcgtatacggcgaaccatatagct

SEQ ID NO: 16526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcccgtgcttgtctctccggaagtcctt

SEQ ID NO: 16527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcccttcgacttcagagcagtccggtcc

SEQ ID NO: 16528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcctaaaagccatccgatatgccatcat

SEQ ID NO: 16529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcctgggctcgagcgagtgacagctgtt

SEQ ID NO: 16530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgaatggctgtcgtgcttcccgttagg

SEQ ID NO: 16531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgagggacatccgttcaagccggcaag

SEQ ID NO: 16532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgaggtaacgcacgcttggctccgatg

SEQ ID NO: 16533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgcacaagggagtgtactattagccac

SEQ ID NO: 16534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgcccgcttcgtacgtacgacgggatg

SEQ ID NO: 16535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgcctgaatttgggtgcctccgcgttg

SEQ ID NO: 16536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgcgcatttgccagcctaacgaacgac

SEQ ID NO: 16537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgcgcggttgtttctcggggtcttggt

SEQ ID NO: 16538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgctaggatttcaccactcggccaatt

SEQ ID NO: 16539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgctccaatgcacggcgggccaatcgc

SEQ ID NO: 16540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcggagcaaatagcggaaaaggggtaat

SEQ ID NO: 16541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgggtgttgaaagtgattatgtccagc

SEQ ID NO: 16542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcggtgcgccaaactagccacctttcaa

SEQ ID NO: 16543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcggtggtaggccaggtcccctgcttcg

SEQ ID NO: 16544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcggttggaatggtttaaggcgcggtgc

SEQ ID NO: 16545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcgtgctgcgttcttgagttccggtttg

SEQ ID NO: 16546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggctcaagtttcgacatcacgcactttgg

SEQ ID NO: 16547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggctcccaagaaagcctctaccgtccgcg

SEQ ID NO: 16548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcttcgtcggatgctacaggaggtgggg

SEQ ID NO: 16549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggcttgacgatttttcgcgggttaggggg

SEQ ID NO: 16550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggaagttcctccttttatcgtggtgttt

SEQ ID NO: 16551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggaagttcctgatgaggggaaatagcgc

SEQ ID NO: 16552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggacaagcgaggatttattagtatgcga

SEQ ID NO: 16553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggacggcgttccgtagttcatctcgggg

SEQ ID NO: 16554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggacgtcccgatgggcgatgcgtgtagt

SEQ ID NO: 16555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggactgttttatcggtcatagttttgca

SEQ ID NO: 16556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggaggatagggatgcctacgattcgtag

SEQ ID NO: 16557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggaggccgcagcgaagtgagctctagta

SEQ ID NO: 16558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggaggcgccgggccgtatagacagcgtg

SEQ ID NO: 16559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggatctggttccagaggagcgttgcccc

SEQ ID NO: 16560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggatgcccggatgggaatcgagcgggtc

SEQ ID NO: 16561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggatgggggcctcagtgttacaaacgta

SEQ ID NO: 16562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcaagccgggtctcagccaacatcgct

SEQ ID NO: 16563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcaggagtgaagagatcccgttgcctg

SEQ ID NO: 16564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcagttcacagctggcgaaagggaggt

SEQ ID NO: 16565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcatggtaccgtttggagagctatata

SEQ ID NO: 16566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggccaaaatgttgcggttggtgtaattt

SEQ ID NO: 16567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggccagcgaggcccattacgtgtggggt

SEQ ID NO: 16568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggccatagcgttcgcgacctgaccgggt

SEQ ID NO: 16569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggccgcgggagtagtgtacatcatatcg

SEQ ID NO: 16570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcgcgttggtttattgctctccccggt

SEQ ID NO: 16571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcggcgacggaaatggcgcaggccaga

SEQ ID NO: 16572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcggctctacgaaacgcggggatatcg

SEQ ID NO: 16573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggcggggaaacgtaatcgatggttgcct

SEQ ID NO: 16574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggggagggggtgagctttgtggtccgctg

SEQ ID NO: 16575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggggatactttgttgctgcagtctcctct

SEQ ID NO: 16576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggggatgccattgctaaaacgcagttatc

SEQ ID NO: 16577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggggatttttggcttaggactctgacact

SEQ ID NO: 16578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggcactggtttcactggcttggcggt

SEQ ID NO: 16579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggggtgaacatcgttggcatggtcgg

SEQ ID NO: 16580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggtgattagtggcgggagcaggctag

SEQ ID NO: 16581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggtgctgcagggttgcgggggactta

SEQ ID NO: 16582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggtggattgtcccgaagatccgaacc

SEQ ID NO: 16583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggggttcaccaagcatagccaaacatag

SEQ ID NO: 16584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggggtcttttaaatgcattaaggattctc

SEQ ID NO: 16585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtaacgtgaaaccataagctccttctt

SEQ ID NO: 16586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtagctttaactagtgttcagtgccga

SEQ ID NO: 16587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtagtccttcgtgatccccgcgctgct

SEQ ID NO: 16588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtcaatttttgtgatgtctgtgaatgg

SEQ ID NO: 16589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtcgaccactcgagcgttgtgtcgttt

SEQ ID NO: 16590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtgaagcggccagacagcggtgcgtgg

SEQ ID NO: 16591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtgaagtatatccgggcaacaggcgtg

SEQ ID NO: 16592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtggagatgggatgtagtgtacgcgct

SEQ ID NO: 16593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtgtgtgttgtgggttgctcgagggag

SEQ ID NO: 16594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggttgatgcgcgtggagacgcacgggtg

SEQ ID NO: 16595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggttgtccgttactacgagctccgtatc

SEQ ID NO: 16596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggggtttgactattcgaacttaagtgagtc

SEQ ID NO: 16597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtaacacccgtaacattgggtgtactag

SEQ ID NO: 16598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtaacgggaacgagactgagcatgctgg

SEQ ID NO: 16599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtaagcgtcgtcacctcgggcttttgag

SEQ ID NO: 16600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtacacggatgggtttgttgacctggtg

SEQ ID NO: 16601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtacgatagtcccacagatacacttgtc

SEQ ID NO: 16602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtaggatccactcttgtttccttgcggg

SEQ ID NO: 16603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtagtgtggacatgcaaaatcgtctttg

SEQ ID NO: 16604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtataagactaaatactatgcggtttac

SEQ ID NO: 16605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtatccaatgctaagtccggacagggag

SEQ ID NO: 16606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtatcgaagggtctatcgagtctcgggc

SEQ ID NO: 16607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtattcaaactgaagaacgagcgactgc

SEQ ID NO: 16608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcaccgcatgcaaatcatcactcagac

SEQ ID NO: 16609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcagaaacgccaggacccgctagagtc

SEQ ID NO: 16610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcaggtaatatcgggcgatggcgtcca

SEQ ID NO: 16611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcatcggtgtggatgatcggcagccct

SEQ ID NO: 16612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcatgggcacagctcagccgaccgtgt

SEQ ID NO: 16613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtccacaaccgcgtgaaggcgatgtaat

SEQ ID NO: 16614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcgaaagtatatcactcggagttttgg

SEQ ID NO: 16615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcggacgcagttatgagtggtatcgtg

SEQ ID NO: 16616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcggaggctcattccgcctgaccaggg

SEQ ID NO: 16617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcggccctagaacagagtggcaatggc

SEQ ID NO: 16618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcggctgtttccaagtctgtcgggtct

SEQ ID NO: 16619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcgggattgtctatcagagggcattgt

SEQ ID NO: 16620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcggtcgcgcgattgataactggtgaa

SEQ ID NO: 16621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcgtgatcgagctgtgatgattatgct

SEQ ID NO: 16622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcgtggccaatctacggtgtgttcaag

SEQ ID NO: 16623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtctgttaagctggtgcagcctggaacg

SEQ ID NO: 16624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtcttgccgcattaagtacacgttcctt

SEQ ID NO: 16625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgacaaccgttactaacacgtaaagta

SEQ ID NO: 16626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgcagagagcgtgggtccctgtgtggg

SEQ ID NO: 16627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgcgagcgcctgctgtacgtatgatct

SEQ ID NO: 16628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgctacagcctcgcagacatttgtacg

SEQ ID NO: 16629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtggaatgtactctgcatcaaaggggag

SEQ ID NO: 16630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtggagacgtggtttgatgggtattgcg

SEQ ID NO: 16631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtggagagggcaaagttgcgtgctggtg

SEQ ID NO: 16632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtggcctagtaccatatattcccgatct

SEQ ID NO: 16633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgggaatgtcagcaggttagtgccgtc

SEQ ID NO: 16634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtggtgggatccccgaattagtcgctgt

SEQ ID NO: 16635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgtagtacgatggcacgcgtatttgga

SEQ ID NO: 16636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgtgcgtgttcccgaggtacttcgatg

SEQ ID NO: 16637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgtggatgtccatcaatcagtacggac

SEQ ID NO: 16638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtgttatggcttcttctggtggcagggt

SEQ ID NO: 16639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttaactgtctcgcacgcttgtcatact

SEQ ID NO: 16640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttaagactcggctcatacataaggaca

SEQ ID NO: 16641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttaatttacagaccatgtaacaagggc

SEQ ID NO: 16642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttcacacgggccgactcgacagtaggg

SEQ ID NO: 16643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttcatggcctttggcacgtggaatccg

SEQ ID NO: 16644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggttgtattgtagagaagtcgtttggaga

SEQ ID NO: 16645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtttattacagctgtgggagttagcatc

SEQ ID NO: 16646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagggtttgtttacatcgtcagttcacatctc

SEQ ID NO: 16647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaaacgggaacatggccgtggcgcgatg

SEQ ID NO: 16648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaaccatgggggcaggtagcctggatcg

SEQ ID NO: 16649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaatccgagctagtgatagggcatccaa

SEQ ID NO: 16650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaatggcggggctgtgaccggtgatgta

SEQ ID NO: 16651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaattccgctaccgacattagtacctca

SEQ ID NO: 16652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacaagtggttgggtgcgttgttggaca

SEQ ID NO: 16653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacacacaccatcctcgtccttgtcgtg

SEQ ID NO: 16654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaccccattggcgtgccctgtttcgctg

SEQ ID NO: 16655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacggcatggaacgcgaatgggttttcg

SEQ ID NO: 16656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacggtagtttatcgtggttaacgagta

SEQ ID NO: 16657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacggtatcaggcacgatactttgcacc

SEQ ID NO: 16658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacgttcagggactagcgctatgatggc

SEQ ID NO: 16659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtacgttgcgctcggagcgatttaggcta

SEQ ID NO: 16660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtactagcgctcacggtcctttttcatcg

SEQ ID NO: 16661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtactgtatgattaatcgtccttgtgtcg

SEQ ID NO: 16662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtagagaaattgttcgggtgcagggagct

SEQ ID NO: 16663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtagccgcgctgaagcggaatttatgcca

SEQ ID NO: 16664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtagcggccgctcatctcaggcttgtaac

SEQ ID NO: 16665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtaggtccatccggtggcctttcgatgcc

SEQ ID NO: 16666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatagtttgcgtcggtagaatcgctgca

SEQ ID NO: 16667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatattgttttttctctacagctttttt

SEQ ID NO: 16668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgaaaatggtaacggcaatcgtgcgc

SEQ ID NO: 16669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgaggattcagggtttctcacaccaa

SEQ ID NO: 16670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgatacacgtagaccgtttgatgcgc

SEQ ID NO: 16671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgctgggttggatcgggtccagggat

SEQ ID NO: 16672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgtcagggactctgtactgcaacggc

SEQ ID NO: 16673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtatgtgtggactaatgttgttccgggcg

SEQ ID NO: 16674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtattggagtctattggtagattgattcc

SEQ ID NO: 16675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcaccctaagggccaggtcttcctagag

SEQ ID NO: 16676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcagatggaatcccttttttgagagtcc

SEQ ID NO: 16677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtccaggctagggtgctacccataacatc

SEQ ID NO: 16678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcccccagtatagctacgctcggtgatt

SEQ ID NO: 16679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtccgaactttaacgtgcggctaccccgt

SEQ ID NO: 16680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtccggggcttagtaggttacgacaggcg

SEQ ID NO: 16681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtccgtgtcatatcacactaactctagac

SEQ ID NO: 16682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcctaaccgagtatttaaatccgattat

SEQ ID NO: 16683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgaatactctggtacgccctcatcgca

SEQ ID NO: 16684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgaattaaaccaactcgatgtaactca

SEQ ID NO: 16685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgaggtgggtatctcgtgtcgtctacg

SEQ ID NO: 16686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgatgtgcccgctggaaccgacagccc

SEQ ID NO: 16687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgcaacgctaatgatttcccggcggtt

SEQ ID NO: 16688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcggcagaggacgtaaaacggccgcgcg

SEQ ID NO: 16689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcggcgattggatagctggccgcggccg

SEQ ID NO: 16690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgggcaacggctctctcattagctgtc

SEQ ID NO: 16691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtcgggcttatgattcctagatgtatatg

SEQ ID NO: 16692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtctgagcactaagccgcccgtctcgctt

SEQ ID NO: 16693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgaaacggaggatgtacatctgtggtag

SEQ ID NO: 16694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgacggcttgaatcagggtcgagcggat

SEQ ID NO: 16695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgagaaacacgcggctgaacgatcatta

SEQ ID NO: 16696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgagagatatgtttggtcaactgacctt

SEQ ID NO: 16697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgagaggctacccatataggccgtctgt

SEQ ID NO: 16698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgatataattatgattcttgccaatctc

SEQ ID NO: 16699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgattcccctatccgagccgcgtgatgc

SEQ ID NO: 16700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcacaaggcctacgaggcattcccgta

SEQ ID NO: 16701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcatatgggtcaaggattctaccgact

SEQ ID NO: 16702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcccacaatggtcttcgatcagcggat

SEQ ID NO: 16703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgccggcttgtataggccagtttaggtt

SEQ ID NO: 16704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcgcgccgtcagccaggtattctacca

SEQ ID NO: 16705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcgcgttaccactgaggattgaagtac

SEQ ID NO: 16706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcgctgattcgggtcacttggatgtgc

SEQ ID NO: 16707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgcgtaggttgggctgataggcatagag

SEQ ID NO: 16708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgctggagttcgcgttttacggctatgt

SEQ ID NO: 16709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggacaaccccataaggaagggccaaca

SEQ ID NO: 16710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggagcggcaggaccattgatgaccacg

SEQ ID NO: 16711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggagggaatcgagtggctgtgcgtggg

SEQ ID NO: 16712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggatgcagcttcgacaagcaggccctg

SEQ ID NO: 16713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggatggcctctccatgtgttctgccac

SEQ ID NO: 16714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggcccaaagggaatcagggttgatcgc

SEQ ID NO: 16715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggccgttgtttgtaggggtgctatgcg

SEQ ID NO: 16716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggcgatgatcgaagggtagtacgcttt

SEQ ID NO: 16717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgggacatttccggtccatgcagcggca

SEQ ID NO: 16718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgggagctccggaacgcctcggaaactg

SEQ ID NO: 16719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgggccccatccggacgaccgccgttac

SEQ ID NO: 16720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgggccgaagagccgctgtacggttcct

SEQ ID NO: 16721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgggcgggtgcggaatactgggcttaag

SEQ ID NO: 16722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggtggactttctcactcgtcgacgcgt

SEQ ID NO: 16723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggtggtcttcacgcggcgctaccgacc

SEQ ID NO: 16724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtggtttgactaccagggcgttgagcgct

SEQ ID NO: 16725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtagcgctgtaatcacgggagtgtgca

SEQ ID NO: 16726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtcaggtttcaccgatctttgtggtga

SEQ ID NO: 16727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtccaagccgtttgcgagtgggtgcca

SEQ ID NO: 16728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtctacaccgctgttaggggtcctatt

SEQ ID NO: 16729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtctacttcccaaatgcgactgtactg

SEQ ID NO: 16730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtgcgctatttgtatacgatgatttcg

SEQ ID NO: 16731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtgctgaccattccaaaacattcggtg

SEQ ID NO: 16732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgtgtcgatccgttactaggtgagtctc

SEQ ID NO: 16733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtgttagcgaccttccgacagcttgtgct

SEQ ID NO: 16734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttagcgttggtacgatctcgtgggcagg

SEQ ID NO: 16735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttagtcctcatgcgacagggtatagccg

SEQ ID NO: 16736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttagttttgttccatgctctcccccttc

SEQ ID NO: 16737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttatcgcgctggcaagtagatcgggact

SEQ ID NO: 16738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttatcggggagttacattcgcagggcga

SEQ ID NO: 16739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttatgctgtcggtaccgaggcttcttag

SEQ ID NO: 16740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttatgttatagtgtcatcctttggcgtc

SEQ ID NO: 16741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttattgtgggttactcatgaatagtgtg

SEQ ID NO: 16742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttcctctagttagttaactatgaaccaa

SEQ ID NO: 16743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttcggggggtgaggacgcgaatgccgcc

SEQ ID NO: 16744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttctgccgagagctacgttcgccaacta

SEQ ID NO: 16745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttctgggttatctaccggcagtacgcta

SEQ ID NO: 16746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttgaccctgaattacttgatgccagact

SEQ ID NO: 16747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttgacgtcctaaccgatccggcagacaa

SEQ ID NO: 16748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttgctgttagtacaatgtgttctgtgtg

SEQ ID NO: 16749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttggagcggctaggctgatttggctagc

SEQ ID NO: 16750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttgtattgtcctgtcgattactcccttg

SEQ ID NO: 16751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttgttacgcacaattttatggttggata

SEQ ID NO: 16752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtttacccttgtcggttccgctgcctcgc

SEQ ID NO: 16753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtttaccgctcgcaactccggtggcctgg

SEQ ID NO: 16754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtttccctcgggttccggtgtgtattcgc

SEQ ID NO: 16755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggtttggcagcttagctcgatgtcctcggg

SEQ ID NO: 16756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttttcccgcacgtgcgaactttccttga

SEQ ID NO: 16757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttttctagtactggagctaaggccgaac

SEQ ID NO: 16758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
caggttttgtattgtattagtgctcgaagtgg

SEQ ID NO: 16759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaaatcacactcatacctacgatcactc

SEQ ID NO: 16760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaacactgtcgcacataggtttccggcg

SEQ ID NO: 16761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaaccatacacgccggacctggattgtg

SEQ ID NO: 16762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaaccatgaccaccgcataaaaacggtc

SEQ ID NO: 16763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaaccgattcctcgtaatcgattttccg

SEQ ID NO: 16764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaacgcgacaggggcctggatcaactct

SEQ ID NO: 16765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaacggggtggtttgagttggtttgtca

SEQ ID NO: 16766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaacccgccccgttgcagcgtgctgaccg

SEQ ID NO: 16767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaccgaagctaactgttactaggacggc

SEQ ID NO: 16768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaaccggtagtcgatccatcggaagtcct

SEQ ID NO: 16769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaacgcaggcatactaggcttggaagcgc

SEQ ID NO: 16770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaacgccctccacttgcggcggcgtggga

SEQ ID NO: 16771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaacgggaacgggtacggccgtttacaag

SEQ ID NO: 16772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaactcgtgtagtagggcttatattcagg

SEQ ID NO: 16773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaagccccgtgtagttctacttactgtcg

SEQ ID NO: 16774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaagcggtagaactggttatgtggtacac

SEQ ID NO: 16775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaatatccaataggtgtattttcgcacca

SEQ ID NO: 16776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaatattgctgtctctaagatatttatct

SEQ ID NO: 16777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaatcggcgcccaattggttatttgtctt

SEQ ID NO: 16778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaatgtacattggcactttcctttagttg

SEQ ID NO: 16779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacactgtaattgggtccgagtcatgtag

SEQ ID NO: 16780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaccccgagttaccaatcgtatcacctga

SEQ ID NO: 16781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaccgatagatcttatgtctattcaccgg

SEQ ID NO: 16782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacctagcagtgggacggctgatgatgcc

SEQ ID NO: 16783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacctctgcgctgttcattttaaagcact

SEQ ID NO: 16784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacgaacggaccgctcattctttctggcc

SEQ ID NO: 16785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacgatacgcccgcgatgctttgacttct

SEQ ID NO: 16786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacgccacagccggttcacacgctgtttc

SEQ ID NO: 16787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacggtggaggcgctggaaccttatcccg

SEQ ID NO: 16788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtacgtactgtacacgggtaacatcgtatt

SEQ ID NO: 16789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtactacagagtctagttactccatacacc

SEQ ID NO: 16790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtactagcatcagtcttgaaccgcatcatg

SEQ ID NO: 16791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtactgaaaatgtttaatggtgtggcatcc

SEQ ID NO: 16792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtactggggacggcaatatcgtgaagctcc

SEQ ID NO: 16793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagaaagcattttggacaaattcctgcac

SEQ ID NO: 16794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagaccttgtagtgttccctatcgccggc

SEQ ID NO: 16795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagagacataggtgcccgggctgtacccc

SEQ ID NO: 16796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagagatacattgggctgtgttcggggga

SEQ ID NO: 16797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagagcggcgcctctgttacgggtcaaag

SEQ ID NO: 16798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagaggcgcgccacccggttatgtttgtc

SEQ ID NO: 16799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagattaggcgtgtgcccctgtagcggtt

SEQ ID NO: 16800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagattgggtaatatcgggtatcctctgg

SEQ ID NO: 16801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcagcaaataacaccgggcagtgctag

SEQ ID NO: 16802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcattataatcctcagtcctgatgctt

SEQ ID NO: 16803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagccccgtgttacctagacgtcgcggcg

SEQ ID NO: 16804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcgaagaatgccatcggttaaacgaga

SEQ ID NO: 16805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcgagccaaagggtctactgtccccgt

SEQ ID NO: 16806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcgcgctaggggactagcttatacctg

SEQ ID NO: 16807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcggatgtcactgttctctttcgcgtg

SEQ ID NO: 16808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagcgggaataatttcgttgattttgata

SEQ ID NO: 16809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagctcgctaatctaccgagtgggcgtgt

SEQ ID NO: 16810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaggaatgtgttcaacggaagtccggcta

SEQ ID NO: 16811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaggaggcttacgagggtctacgaccacg

SEQ ID NO: 16812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagggagtgactggtcgtatgtactagct

SEQ ID NO: 16813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagggcaggctcgggggagcagggcctaa

SEQ ID NO: 16814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagggcgtgttgcgtctcccgggctttat

SEQ ID NO: 16815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagggtgcaatgcatgtgagattggccaa

SEQ ID NO: 16816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtaggtctcttgagggtcattcattctctt

SEQ ID NO: 16817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagtagcttgccaactccccaacaggcct

SEQ ID NO: 16818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagtctgttaagtccgagcgttacgtttt

SEQ ID NO: 16819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtagttccaggttagtctttgcacggtgtg

SEQ ID NO: 16820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatacatgcttactgactggaatggcgca

SEQ ID NO: 16821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatagggaccgtcacatgcctagggttgc

SEQ ID NO: 16822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatatgatcacctcgggctctgatgctgt

SEQ ID NO: 16823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatcacaacgtcggaggagtgcaagtgca

SEQ ID NO: 16824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatccccgtcattatctatatcgggttag

SEQ ID NO: 16825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatcggaatccattgccaaaacgagatta

SEQ ID NO: 16826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatcggcatagggtcttgccttaacccga

SEQ ID NO: 16827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatgaacatacctctgtgggttggataga

SEQ ID NO: 16828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtatgctgttggcaattgttatggttctgg

SEQ ID NO: 16829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtattaagcaaagtgcaccaggacgtgcga

SEQ ID NO: 16830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtattagggatttcgggtagacgtttacct

SEQ ID NO: 16831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtattctctgcgttaacgcacttatcgcga

SEQ ID NO: 16832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaaacgtctttggccggatagcacgcgg

SEQ ID NO: 16833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaatatcagctatggcagaaagactgag

SEQ ID NO: 16834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaatctaggcccgggttcagctggtgag

SEQ ID NO: 16835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaatgacaaatccgaagcgttctcttgg

SEQ ID NO: 16836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaccctcggtcttgcgtttccgtggagc

SEQ ID NO: 16837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaccggcagcggtaccactaggcaaccg

SEQ ID NO: 16838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaccgttgatcctccactgatcgtaacc

SEQ ID NO: 16839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcacgatacgtgtatttggtggctggatc

SEQ ID NO: 16840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcacggaccgaatcagcgctgctcgcggc

SEQ ID NO: 16841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcagaacgatacggtaggggggcggtata

SEQ ID NO: 16842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcagagtaccacgtaatctacagcttcgc

SEQ ID NO: 16843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcagctctcggtgttttcatttaggcttt

SEQ ID NO: 16844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaggatgtagccctacggtgtcccaaaa

SEQ ID NO: 16845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcaggcgggatgacataggttattactct

SEQ ID NO: 16846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcagggcacgtcttatcacgcaccacggc

SEQ ID NO: 16847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcagggcacgttcccatctctcttcagtg

SEQ ID NO: 16848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcatacccacgtagacttacaggcggaac

SEQ ID NO: 16849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcatccagcgtgtggaaacgactccaact

SEQ ID NO: 16850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccaatatcggagcttctgtacggaccgt

SEQ ID NO: 16851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccacaccagtgtgcgaacgggcttctat

SEQ ID NO: 16852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccacgcgcttgccgaccacacgtgtgtt

SEQ ID NO: 16853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccagcaccaatatctctactctcgcagg

SEQ ID NO: 16854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccatgccagcacgttgaaaaggaccggt

SEQ ID NO: 16855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccccactcgcgaattcccaagacacacg

SEQ ID NO: 16856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccctcccaacggatgctcgggactcgg

SEQ ID NO: 16857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccgccggctctccataattaggctccc

SEQ ID NO: 16858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccgcctccctgacatgcaaagttacgt

SEQ ID NO: 16859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccgcgagaactggttactctgtgtttg

SEQ ID NO: 16860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccggcattttatgggctatccccgcac

SEQ ID NO: 16861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccgtactcgtcaggctcaagactgaac

SEQ ID NO: 16862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccgtcgtttacgtcgttcctccgtgta

SEQ ID NO: 16863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccctcactacagtttggggcatcgctgg

SEQ ID NO: 16864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccctggcgggggcttaattagcagtggg

SEQ ID NO: 16865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcccttgatcggtcagtttcgaacgcgtg

SEQ ID NO: 16866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccgcgagcgccacgtccattgatggata

SEQ ID NO: 16867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccgctcgttaagacgccagtaccctccg

SEQ ID NO: 16868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccggacatgctttgttcagccaatttga

SEQ ID NO: 16869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccgtccaggctcatttcctcgtcggctt

SEQ ID NO: 16870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccgtgcaaatttaacggcggctttccac

SEQ ID NO: 16871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccgtgcggtaggcatagtcagctgtcat

SEQ ID NO: 16872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcctgtgggcgtgatactttgggccgttt

SEQ ID NO: 16873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtccttttgtagagtttgcgtgtttgcagg

SEQ ID NO: 16874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgatacccgatccgcttggacatgattc

SEQ ID NO: 16875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgatcggcggtgacaatcgggtcatcta

SEQ ID NO: 16876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgatgcggaacaatgagcctcgctgctg

SEQ ID NO: 16877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgatgttacttttcgtgtgctgggtctc

SEQ ID NO: 16878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgcaataattgcgtgaaatccgcctcac

SEQ ID NO: 16879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgcttgaggacggatcagatttgctcat

SEQ ID NO: 16880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcggcagagtcgttacctcagtgggcata

SEQ ID NO: 16881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcggcgtgcataataaggcgtccaagaga

SEQ ID NO: 16882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgggaagtgggtgggatagcggttcctc

SEQ ID NO: 16883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgggcggggtaggggcttaatcggacgt

SEQ ID NO: 16884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcggtaagtcgagtatgggggtccagagg

SEQ ID NO: 16885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcggttctccagtcatacattccaggccc

SEQ ID NO: 16886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgtcgtagtccgtgagtacaatgctcgc

SEQ ID NO: 16887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtcgtgagcggtggtcttgtgcgcacggtt

SEQ ID NO: 16888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctacaaggacgagagctgattatttaga

SEQ ID NO: 16889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctacatggtacgctagtgtgtaatccat

SEQ ID NO: 16890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctatgctggtcctcgcactctacgatac

SEQ ID NO: 16891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctattatgcatagtaaacatgtggaccg

SEQ ID NO: 16892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctcctaatgggagcaagagtaaagtagt

SEQ ID NO: 16893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctcggagttcagcagaccttgcggccga

SEQ ID NO: 16894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctcgtgctacagagtacggcatccgatc

SEQ ID NO: 16895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgcaacaccgccccctgcccgaattcc

SEQ ID NO: 16896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgcagactagagctgggaaaaggtaag

SEQ ID NO: 16897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgcgagtcgattatttgtgatacattg

SEQ ID NO: 16898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgcggcggaagattaatttttaccttc

SEQ ID NO: 16899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgcggtgagagacctaagagctaatga

SEQ ID NO: 16900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctggatcgtgtccacacccggttgagtt

SEQ ID NO: 16901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctggcgtttgggaattcgattcttctac

SEQ ID NO: 16902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctggctctcgttacatacagctttgggc

SEQ ID NO: 16903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctggtgtcaatgtgcgcgcggggtcggt

SEQ ID NO: 16904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgtctgcacttgctattgcgatgcctc

SEQ ID NO: 16905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgtggcgtacccacgacatgtctgctg

SEQ ID NO: 16906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgttactcttcatgctgcgtcttgagg

SEQ ID NO: 16907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctgttcacggtcagcctcgcatcgtgac

SEQ ID NO: 16908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtctttgggatgcgtccatctcgacaacaa

SEQ ID NO: 16909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaaaaggcttacccacgccgtggttcca

SEQ ID NO: 16910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaaccagtcgggccacctggtttgctca

SEQ ID NO: 16911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaacggatgcacaaaagttgcgttatgg

SEQ ID NO: 16912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaagcactggggtataaactgcgctctt

SEQ ID NO: 16913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaatagttttcagacggcaggcttaggt

SEQ ID NO: 16914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaattctctgcgttcaccagtacggccg

SEQ ID NO: 16915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgacacataacgtgtgacctttaagaaga

SEQ ID NO: 16916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgacacgggcggggcggaaaagagaggcg

SEQ ID NO: 16917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaccgcggttctgatgaactttctaata

SEQ ID NO: 16918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgactcgtggtaatgatcggagggttagc

SEQ ID NO: 16919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgactgggcagccgtccgggacgttagct

SEQ ID NO: 16920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgagcctgccggtgctgggtgtcgacgga

SEQ ID NO: 16921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgaggcgctatgaacgactcggatctcgg

SEQ ID NO: 16922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgatcaacccctccctttggatgaccctc

SEQ ID NO: 16923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcaagacagtgactctagccttggaagg

SEQ ID NO: 16924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcaataagaggcaaccggacacggccca

SEQ ID NO: 16925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcaatcccgtgtcagatttcaacagggg

SEQ ID NO: 16926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcacccgggctaatgaggattatttcac

SEQ ID NO: 16927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcacgaacgaatatggatgtcatgttca

SEQ ID NO: 16928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcacgcctcactggtttctcgcgtctaa

SEQ ID NO: 16929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcaggctcgccgtcccgtgcttgtggaa

SEQ ID NO: 16930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcagggcatatcaataccgaatcgcagt

SEQ ID NO: 16931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcatccactcagatttcgtcgtttgggg

SEQ ID NO: 16932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcattctcctacggttggcacggctact

SEQ ID NO: 16933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgccaccacgacttgggtgggcctcatta

SEQ ID NO: 16934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgccaggaatctaggcaacttggggggga

SEQ ID NO: 16935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcccgaccgtgaagcagaatccctgagc

SEQ ID NO: 16936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcccggccctacgatgagtcgcgtcgac

SEQ ID NO: 16937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcccggccggacagggtggggttgtgat

SEQ ID NO: 16938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgccgagggatcgtatcgttcccagcgtg

SEQ ID NO: 16939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgccgcgtctgaccgaaacctatctggca

SEQ ID NO: 16940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgaattacaagttttccatcagattta

SEQ ID NO: 16941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgctatgtgtcttaatgggatgcccgg

SEQ ID NO: 16942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcggaatgcggttgtcgtgtggcggtaa

SEQ ID NO: 16943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcggccattgtagggagttgccggcctg

SEQ ID NO: 16944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgggatcagctactcccagaagcaggg

SEQ ID NO: 16945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcggtccatgctttgaaacggggatagg

SEQ ID NO: 16946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcggtttaggtgacggcggacccgaggt

SEQ ID NO: 16947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgtatatcttactaagtggctcgtctt

SEQ ID NO: 16948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgtctgttttaaaacgatcggagggtg

SEQ ID NO: 16949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgcgtgtaaccggtacgcgtctgctctta

SEQ ID NO: 16950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctaagacgaaattgtccgctcgggctg

SEQ ID NO: 16951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctaagcgtaagcttgccattcatccgc

SEQ ID NO: 16952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctataccgttcgaaatcatgtcagtca

SEQ ID NO: 16953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctatctattactagtgggtatgttaga

SEQ ID NO: 16954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctcccattacttggacggttctggtgc

SEQ ID NO: 16955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctcctgtgtcatgttgatgggaaataa

SEQ ID NO: 16956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctcgcacgggggacgctcatgcgctgt

SEQ ID NO: 16957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgctttgccttagggccgttatacctacg

SEQ ID NO: 16958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggaaagagcggttagggacccgcaggtt

SEQ ID NO: 16959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggaagccgggttgaggggatataagggc

SEQ ID NO: 16960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggacggaatagcaatgccccgccgtgtg

SEQ ID NO: 16961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggactgacaaacctttgactccaggtgg

SEQ ID NO: 16962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggaggtaagcactacataatcctggcgt

SEQ ID NO: 16963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcaagggcgcctacgagctataactat

SEQ ID NO: 16964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcatggaagtaggcgcgaatttgcatg

SEQ ID NO: 16965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggccccctataccgcggtgtaaatgcct

SEQ ID NO: 16966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggccgatgtggttgttgctgtcacgacc

SEQ ID NO: 16967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcgaccacgtatttatgaaaatgggca

SEQ ID NO: 16968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcgacggggcgatcagattcatgcact

SEQ ID NO: 16969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcgatcagtcggcggcctgggaagcgt

SEQ ID NO: 16970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcgcctgagttggcacagtggctacgg

SEQ ID NO: 16971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggcgggcgaccggtgggttatgcgctcg

SEQ ID NO: 16972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggctcggtctccgaaaagctcagctctg

SEQ ID NO: 16973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggctttcggaggtcagaatctggacggg

SEQ ID NO: 16974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggacgttcaaaccagggtcatttgtcg

SEQ ID NO: 16975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggagtgtgtgcgataagtgaagagcgg

SEQ ID NO: 16976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggcacaatgactagggaacgaccggcg

SEQ ID NO: 16977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggcgatacatttggatggtgatccccc

SEQ ID NO: 16978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggcttctaaccttgaggagcagatcgg

SEQ ID NO: 16979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggggcagctgaaatccctataaagcacc

SEQ ID NO: 16980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggggggcataatgaagtcaaccggggtg

SEQ ID NO: 16981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggtggtgggcacctgggctttcgagca

SEQ ID NO: 16982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgggttgaggaggtagcgccctaagttat

SEQ ID NO: 16983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggtaaagtgtctaaatcgtaatggttcg

SEQ ID NO: 16984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggtaaggtggtgatccgcaagtatgggg

SEQ ID NO: 16985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggtattaacggtaggctcgttctaaatc

SEQ ID NO: 16986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggtggatgttttttggccagtatgcacg

SEQ ID NO: 16987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggtggggagacggggtaccttaaaaccg

SEQ ID NO: 16988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtggttagcaaataagagaacaagctctaa

SEQ ID NO: 16989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtaaatctcatgtggtaattactaggaa

SEQ ID NO: 16990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtaagagtgtctggcctttgagcattgc

SEQ ID NO: 16991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtacaaaaccctgtgtattgttcggggt

SEQ ID NO: 16992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtacaaagagggctggcggtacgttgcc

SEQ ID NO: 16993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtactataggtaacggctggtagatcaa

SEQ ID NO: 16994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtactcgatgacttgtaagtagcgaaag

SEQ ID NO: 16995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtacttcatggtaattatgtggcttcat

SEQ ID NO: 16996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtaggctactcactgggggtgcgcgtgt

SEQ ID NO: 16997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtaggtttcgtctcaaatcgatcattgt

SEQ ID NO: 16998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtatacgggccccacgcttcctcagtct

SEQ ID NO: 16999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtccatcgttcatggcccttgccctgta

SEQ ID NO: 17000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtccggcgtcgcgtacttcgtggcgtgc

SEQ ID NO: 17001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtcgggactatagcgggcgaaagacaac

SEQ ID NO: 17002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtcgttgtgacggctgtgatgagttcgc

SEQ ID NO: 17003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtcttgtggggggtccgccccgggctgg

SEQ ID NO: 17004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtgaacggcgcgataaatcccacttctg

SEQ ID NO: 17005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtgagatgggtatcatcgtgtttcatag

SEQ ID NO: 17006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtgcgttattgatgattcgcaaccgttt

SEQ ID NO: 17007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtggccgccgcaaggaggggtaaggtcg

SEQ ID NO: 17008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtgtgtgacaatgcacggtagcctgctc

SEQ ID NO: 17009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgttgcacgcgggatgtgatcaccattac

SEQ ID NO: 17010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgttggggaggactgaactttcgcccaag

SEQ ID NO: 17011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgttgtctgtacttcgatgactcagcgtg

SEQ ID NO: 17012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtttctatacggtatccgtctgttaatc

SEQ ID NO: 17013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgtttggtgtgcaagctgtggtaagatgc

SEQ ID NO: 17014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtgttttaccttgaaagccaatgatgtagc

SEQ ID NO: 17015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttaagttgttgttacttggaggggggtgc

SEQ ID NO: 17016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttaccatatctgtgaaccgatccgcacaa

SEQ ID NO: 17017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttacgcggatgaccggtgatcgcgtttgg

SEQ ID NO: 17018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttacggagtacgcttgtaaacctttcctg

SEQ ID NO: 17019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttactcaagtacccgtccggttaacattg

SEQ ID NO: 17020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttacttacatcctaccagttttgttatgc

SEQ ID NO: 17021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttagagttttgcatttgttatccagctca

SEQ ID NO: 17022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttaggcaatagctattgttgacccgttcg

SEQ ID NO: 17023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttagggcaaggagttggtttgcaagtact

SEQ ID NO: 17024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttatcagtgcgtgaaattcattgagttcc

SEQ ID NO: 17025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttatcgttttgctaatgtcacttaagatc

SEQ ID NO: 17026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttatgaggccaatgctactgttcgagccg

SEQ ID NO: 17027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttatggacagttcggcagccactccgctt

SEQ ID NO: 17028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttattggcgccccccagtacctcaggctc

SEQ ID NO: 17029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcaaaggaggcgcctcggggtttcgctg

SEQ ID NO: 17030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcattcaccggccatgcctcgagggcaa

SEQ ID NO: 17031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcatttgcgcgcacgacggagagaaagc

SEQ ID NO: 17032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcccgcatcggacaacgtgtcagaagga

SEQ ID NO: 17033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcccggctgcgacaagggcaattctccg

SEQ ID NO: 17034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcccgggggtactctccctggttttgct

SEQ ID NO: 17035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttccggaggcagcgtgtctttatgacgag

SEQ ID NO: 17036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttccgtttatccagagcgacgttaaccgt

SEQ ID NO: 17037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttccttccgatgggattactcagaacggc

SEQ ID NO: 17038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcggccaaggaatcatcatcctacggag

SEQ ID NO: 17039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttctactttcactggatgcgtcaacttaa

SEQ ID NO: 17040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttctgtcatgttgtcttgtcctacttgcg

SEQ ID NO: 17041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttcttcaagcaatgatttgcgcggcgtgc

SEQ ID NO: 17042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgacgccgggtcgacgaagggctgtatg

SEQ ID NO: 17043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgacttaggcccacgagcacgttgtgta

SEQ ID NO: 17044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgatctgcagatgcacttggaagcggcc

SEQ ID NO: 17045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgatgctctacttaactgactcctgcca

SEQ ID NO: 17046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcaattcagcttgactgtgcggcgagt

SEQ ID NO: 17047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcacctcgctctcgagggttcggtcgg

SEQ ID NO: 17048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcacgaccatcaggtccgttatctgtg

SEQ ID NO: 17049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcccacgtccgaatcggagtatacgta

SEQ ID NO: 17050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgccgaagctaagcgatcccacgggctc

SEQ ID NO: 17051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcctaccccgctattggctggaaggat

SEQ ID NO: 17052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcgcggaaggaatgtctagccggcacg

SEQ ID NO: 17053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcgcggagtgccatcgtattcgttgta

SEQ ID NO: 17054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcgtgtaaattgacctgactgacttgt

SEQ ID NO: 17055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgctacgggagcattggacttagggaca

SEQ ID NO: 17056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgcttttaatgggcgttgcgacaaccga

SEQ ID NO: 17057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgggtatggctgtacgcaagacacgatg

SEQ ID NO: 17058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgggtggcgttaccggcaggtgtactct

SEQ ID NO: 17059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgggtgtgtttaccagaaagcattagtc

SEQ ID NO: 17060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttggtgcaaaagcctggggagacgtacac

SEQ ID NO: 17061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttggtttctggcgcaataggtcgtgctag

SEQ ID NO: 17062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgtaccttttctacaggtgcacaacgtc

SEQ ID NO: 17063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgtagtgcaatctacaccccattgatcc

SEQ ID NO: 17064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgtcagtgaagccgctattctgtcatga

SEQ ID NO: 17065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgtccggggttcagttgtgtccctccaa

SEQ ID NO: 17066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgttccccggatctggggcattttgggt

SEQ ID NO: 17067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttgttgtccgcacattttgccgttcgtca

SEQ ID NO: 17068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttaatcgactctggctcttgtctgcttc

SEQ ID NO: 17069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttattttgagaatgcactattttatctg

SEQ ID NO: 17070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttcaagttggcgccttgagcaatgacta

SEQ ID NO: 17071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttccagcggtgcaatctaagtgtgtcgg

SEQ ID NO: 17072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttcgaagcgtcgtatcgggcatcccacc

SEQ ID NO: 17073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttctcagatgagtccgcggaaacaaagc

SEQ ID NO: 17074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttgctctctttatgttaaggactgcaac

SEQ ID NO: 17075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttggcgaatgcccgcctgtggggtcgcg

SEQ ID NO: 17076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttgggccaggttttcacggcaagacaaa

SEQ ID NO: 17077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttttaatcgatacctggcgagtctgcccg

SEQ ID NO: 17078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttttcctcacttggtgggcgttcgctatg

SEQ ID NO: 17079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttttctcgcgtcggttcggccctttgaac

SEQ ID NO: 17080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttttgcttagaccttattggttcattatc

SEQ ID NO: 17081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagttttgtacattattttaaaccctcaaggc

SEQ ID NO: 17082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cagtttttggacagttatgatgctttctgctg

SEQ ID NO: 17083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaaatcgccggcacttgaagagacttcac

SEQ ID NO: 17084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaaatttcgagcattacagcgggcgacgc

SEQ ID NO: 17085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaacgatctggtaatattgttcaattgtg

SEQ ID NO: 17086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaacggcaatgtggcacagttgctatccg

SEQ ID NO: 17087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaactcctgaaggcgtagcgtgcattaga

SEQ ID NO: 17088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaacttcctgtttccggcgaaatgttgga

SEQ ID NO: 17089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaaggcagcaacattattcctcccgggtg

SEQ ID NO: 17090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaagtatggaagtcggcccgacgtacgag

SEQ ID NO: 17091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaagtgactcgtcgacgcgcaaaggttgg

SEQ ID NO: 17092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaattgagggttgccgtagtgttccggct

SEQ ID NO: 17093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacaacgctggccttgcgtctgtacgatc

SEQ ID NO: 17094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacacggtggtggagaacgggtgatatag

SEQ ID NO: 17095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacagagcatcgtacttttcctgtggggg

SEQ ID NO: 17096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacatcattggacggtggacgcatcaaca

SEQ ID NO: 17097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaccacgagtttaccacactggcttttgc

SEQ ID NO: 17098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaccgtcccgcggctcattgttctcacga

SEQ ID NO: 17099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaccttcatatggtagtttgggttctcgc

SEQ ID NO: 17100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacggcctctctaagtgggcttgacggtt

SEQ ID NO: 17101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacgggttacaaggcataacacagcgctc

SEQ ID NO: 17102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataactaatgcagccgtggttttgatttata

SEQ ID NO: 17103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataactggtcttaggtttgctcagggtgtgt

SEQ ID NO: 17104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataacttggttcaaatggcggcatgcagctc

SEQ ID NO: 17105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagaattggtgtccgggggactatgcatc

SEQ ID NO: 17106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagacgtaccctcgatttgaccctcgatt

SEQ ID NO: 17107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagcaaggaaacctattcactgcttatta

SEQ ID NO: 17108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagcgcccgacgacacgagttagggattt

SEQ ID NO: 17109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaggaacggatgctccccgattccggagg

SEQ ID NO: 17110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaggcggtcttggtcgattttaagaggtc

SEQ ID NO: 17111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagggcccacttctgagggggaaccgtgg

SEQ ID NO: 17112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagggtttaccgtcctactggggtgcgga

SEQ ID NO: 17113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataaggtcgctctatgatgtctgcggtcgag

SEQ ID NO: 17114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagtatcggttggtgactaggctcccgcc

SEQ ID NO: 17115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataagtgaggtactggcggggatggttgcct

SEQ ID NO: 17116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataataaggtgtactgcttgtccgtgatcac

SEQ ID NO: 17117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatattcgataggttccaggccccagttg

SEQ ID NO: 17118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatcagctatcgacgcttggcatgttccg

SEQ ID NO: 17119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatcgggcacccgggacattccgaggagg

SEQ ID NO: 17120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatctccgcagtaggacaagctttacatt

SEQ ID NO: 17121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatcttcctccccgggcgtcttcttcaga

SEQ ID NO: 17122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataatgttgttcaataaagctcggcattccg

SEQ ID NO: 17123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataattatccgctcgctgcctttttcttgca

SEQ ID NO: 17124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaaccgccgcggccatccgctagtttgg

SEQ ID NO: 17125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaactcttttactccgagtgacaggccg

SEQ ID NO: 17126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaagcgaacgttatcatttacggctcat

SEQ ID NO: 17127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaagctaccactggcactggctgaccgc

SEQ ID NO: 17128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaaggcgagggacccagatgtcctcgtc

SEQ ID NO: 17129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaagtgaactgttggactcagctaaatg

SEQ ID NO: 17130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacacatggacccagttctgtttcgctgcg

SEQ ID NO: 17131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacacgagccatgttagtgccggggggtgt

SEQ ID NO: 17132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacacgatcaccgaaggcccgcgagaggcg

SEQ ID NO: 17133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacaggtccagtatacttagatgtcaattg

SEQ ID NO: 17134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacatacgcgggagtggtgattcattgagg

SEQ ID NO: 17135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacatcgtccttggatccgcagctggcagc

SEQ ID NO: 17136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacatctcgtgctctccggcttttgttgcg

SEQ ID NO: 17137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacccatgagcagccagttgggcaatccgc

SEQ ID NO: 17138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccccttgcggcaaactgttctatgggcc

SEQ ID NO: 17139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacccggtcgcttaattacttcctcgtagc

SEQ ID NO: 17140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacccgtaccgactggcgatgtatggcatg

SEQ ID NO: 17141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacccgtattgcgcatggtgtctggtgtgc

SEQ ID NO: 17142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacccgtgtcatattgaataaatcttaggt

SEQ ID NO: 17143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccgagctggatgcggtgctgagccacgg

SEQ ID NO: 17144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccggcgttaaggctgcgaagtggtgtgt

SEQ ID NO: 17145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccggggaacaagacactcggttctggca

SEQ ID NO: 17146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccgtcaggttgaacaggtaaagcttgcg

SEQ ID NO: 17147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataccgtcatgcacgcggctgattttgcttc

SEQ ID NO: 17148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacctcgatcgaactggggcttgttcgggg

SEQ ID NO: 17149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacctcgggagtctcccccaattccgtctc

SEQ ID NO: 17150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacctgcaccttcaatcctgtgctccgtgc

SEQ ID NO: 17151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgaaggacgcaggcctgacgcagaggct

SEQ ID NO: 17152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgagaatggggcgtccctccattccagt

SEQ ID NO: 17153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgataggtccaagcgtgctggttggtac

SEQ ID NO: 17154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgatcccggactacgctgggggacgatg

SEQ ID NO: 17155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgatgagtgaccgtaggtagcgatgaga

SEQ ID NO: 17156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcctgaccgtgtgtggcgagtggcacg

SEQ ID NO: 17157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgaccaaatcatattcaacgcacgcc

SEQ ID NO: 17158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgcgcgagtgtcgaggcagtgactgc

SEQ ID NO: 17159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgctggtcagtgttacgtcgtaggat

SEQ ID NO: 17160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgggcttgagtgcgatggtatgtgca

SEQ ID NO: 17161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgggtggttggtgcggttttgtggta

SEQ ID NO: 17162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgcgtatccagatgttctttccccatgt

SEQ ID NO: 17163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgctctccaaggttttcctaattaatgg

SEQ ID NO: 17164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgctgctcacgtttacagtctgacacgc

SEQ ID NO: 17165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggaataccgggcgactctttactggta

SEQ ID NO: 17166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggagtattgagttgtgtatgtcatcat

SEQ ID NO: 17167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggcagggaaaacgacaggtggcagcac

SEQ ID NO: 17168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggcatgacacgggcgcctccattacgg

SEQ ID NO: 17169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggcgatgctagcccgaggttcccggag

SEQ ID NO: 17170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgggagataacgtctcgagagatagtag

SEQ ID NO: 17171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgggcttttagtcatgcacctctgaagt

SEQ ID NO: 17172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggggcccggtgtcgtcgaattgagaca

SEQ ID NO: 17173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggtacggagccgaggcgttagcgtggt

SEQ ID NO: 17174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacggtgttgcgacctctggccggtgtggc

SEQ ID NO: 17175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgtaagtacctacacgccagcccgtcaa

SEQ ID NO: 17176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgtacggactgggatcggcagttggatc

SEQ ID NO: 17177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacgtagtaggacgcgtgtgctaatcgtgc

SEQ ID NO: 17178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactaaactgacctctgaagaacccagtac

SEQ ID NO: 17179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactaactacaatgtcgcgatcctggcttc

SEQ ID NO: 17180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactagacgtctggttgactttcagggtta

SEQ ID NO: 17181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactcccatcctcatgctatcgactgtacg

SEQ ID NO: 17182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactcccgtccttaaagtcctatgagctac

SEQ ID NO: 17183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactcctacagaaatggtgcgagtcatctg

SEQ ID NO: 17184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactcggtagccagatattctactgcttcg

SEQ ID NO: 17185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactgacttgagcgggttatgctcccgcga

SEQ ID NO: 17186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactggatgtgttcttcgatttgggggggc

SEQ ID NO: 17187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactgggcgcacagcagccacgcatcagcg

SEQ ID NO: 17188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactggtgtaggcatggagaatggagtaga

SEQ ID NO: 17189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catactggttcatcagatgcaatcttgtaacg

SEQ ID NO: 17190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catacttcagtgcatacatggcaaccgtggcc

SEQ ID NO: 17191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagacgtgggcacgtgaggggagagctcat

SEQ ID NO: 17192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagagggaaggcaacgtggtaacccagcga

SEQ ID NO: 17193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagaggttcttgcggattgggtcccccggc

SEQ ID NO: 17194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagatatttcagtgggaagtggaaagatcg

SEQ ID NO: 17195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagatcaaacgggcgaagccgcggaccgat

SEQ ID NO: 17196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcacgacctctgaccccccttgcgttcc

SEQ ID NO: 17197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcaggcgtgacgatcgtgccggggccgc

SEQ ID NO: 17198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcagtacgagataagagtgtctaggatt

SEQ ID NO: 17199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcattactcggaacttgagatcgccacc

SEQ ID NO: 17200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcccctgtaggtatttcttgtccccgcg

SEQ ID NO: 17201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcgaatcaggtatcggaggctatggatc

SEQ ID NO: 17202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagcggtgtaatggttccagggttgcgtgt

SEQ ID NO: 17203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagctgtaaatcgttttttatttaggtcga

SEQ ID NO: 17204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggatccaatacagccatatccccgcaat

SEQ ID NO: 17205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggcaagtctaggtggtattatcgtttct

SEQ ID NO: 17206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggcaatcgttgatttgcatgtatcctcc

SEQ ID NO: 17207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggcaggcacttcacgcgagttttccgag

SEQ ID NO: 17208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggcattgtgtcgagatgcttaacgggcg

SEQ ID NO: 17209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggctaacactacatgcaggcggtggagc

SEQ ID NO: 17210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggctcggtgcccgtattgctggcgaacg

SEQ ID NO: 17211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggacgagggactacgcaccgtacacgg

SEQ ID NO: 17212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggcgcatcaccttatcgattagcgtct

SEQ ID NO: 17213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggctaacaaatgagctgccctctgtcg

SEQ ID NO: 17214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggggatgaatatttgataatagaatgag

SEQ ID NO: 17215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggggcgcagctataggtgcagtgcgac

SEQ ID NO: 17216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggggtaccaggtgttcgagcggggttg

SEQ ID NO: 17217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggtatagtacaggatgcgcaatggtcc

SEQ ID NO: 17218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagggtcctagtccctgaatgtgaaattcc

SEQ ID NO: 17219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggtccaaggtagaaaccccaaggtcagg

SEQ ID NO: 17220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggtgaagtgcacggctagacccgatcgt

SEQ ID NO: 17221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cataggttgcgcagtgacgcgcaatacgtctg

SEQ ID NO: 17222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtacacctcaagttatcttaccacaatt

SEQ ID NO: 17223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtagattggcaggtatgggattttgagc

SEQ ID NO: 17224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtccagcccgagttgacagtatacgagc

SEQ ID NO: 17225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtctaaagtattgtggataagtgctcat

SEQ ID NO: 17226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtgataagattgcaggatcctgtcgtat

SEQ ID NO: 17227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtgatgtttcataccggtgttggccctt

SEQ ID NO: 17228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtgccgcaactgtgtaatcgcttaggtc

SEQ ID NO: 17229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtgttcatggtcagcggggtccgttgca

SEQ ID NO: 17230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagttgatcttgttcagagacgctactacg

SEQ ID NO: 17231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagttgctcgatttcgttctgcccacgttc

SEQ ID NO: 17232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtttcccccggcatggatgttcgtcacg

SEQ ID NO: 17233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catagtttgctaccagctcaccgctcgttaag

SEQ ID NO: 17234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catataaccacgcacgtaacgtttcgccacgg

SEQ ID NO: 17235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatacctaaccgctgctgtaaggagatatt

SEQ ID NO: 17236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatacgggggctcgtatctaccccttcggt

SEQ ID NO: 17237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatagaaggcagctgttcgagtcagaaggg

SEQ ID NO: 17238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatagagtgggccagcctacatcctggttc

SEQ ID NO: 17239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatagcacgccaggcgtactcgtcaccagt

SEQ ID NO: 17240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatagttagaagtcatcacttttaggtggt

SEQ ID NO: 17241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatatcttcggcatccaaagaactttcggg

SEQ ID NO: 17242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcaagcaacatgcgacgcgacggaccgt

SEQ ID NO: 17243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcaccgcaactcaccaatcgcgaccgca

SEQ ID NO: 17244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcacgatggcatttacttacggatgcct

SEQ ID NO: 17245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcaggcatcttatgattgttttatcggt

SEQ ID NO: 17246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcatggtggggtccacatcctctaggcc

SEQ ID NO: 17247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatccggccctgggacttacctgcttcaca

SEQ ID NO: 17248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcgcacacctaagacgcatcttggagtc

SEQ ID NO: 17249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcgggctgctggaggttataaaatggta

SEQ ID NO: 17250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcggtcgcatagagggggactcgcgcgc

SEQ ID NO: 17251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatcttctggtgttgtcagttcgagatggg

SEQ ID NO: 17252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatctttattccggcagcttcagatcagtg

SEQ ID NO: 17253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgacatctgccggatccgtcggtatagg

SEQ ID NO: 17254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgactcagcggcccatacatatagcgat

SEQ ID NO: 17255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgatggaacgtttacactttgagcccgt

SEQ ID NO: 17256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgcactcaagtggtgtcgtcagcgctag

SEQ ID NO: 17257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgcgttatgaacggccggggagcaggga

SEQ ID NO: 17258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgctgcggggacggcgctcacatgtgtg

SEQ ID NO: 17259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatggaacgtttatcgcatttaggggtaat

SEQ ID NO: 17260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatggctcccgctaattaatttatacttta

SEQ ID NO: 17261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgggccaatccggataattggatcgctc

SEQ ID NO: 17262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgggtcgcgtttgggaaccgacttcatg

SEQ ID NO: 17263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatggtgttttaaggacgcgcgtatgattt

SEQ ID NO: 17264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgtagccttaggaattggcccgttgctg

SEQ ID NO: 17265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgtcgggccacggaaaccgctccagagg

SEQ ID NO: 17266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgttcggcgtgttcattaaccctctccc

SEQ ID NO: 17267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatgttgttaaggccatttttccaatatcg

SEQ ID NO: 17268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattaacctggggagggggatgcagtcgct

SEQ ID NO: 17269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattaagctgccccacttcgattaggtatg

SEQ ID NO: 17270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattattcgtcgcctcggctcacggtaagg

SEQ ID NO: 17271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattcaggaattttttaccagtactatcgt

SEQ ID NO: 17272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattcctaccggcagcacatcggcgtatct

SEQ ID NO: 17273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattcctgtttcgttcgatggggagggtga

SEQ ID NO: 17274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattgggaatcggaggtcgtggcggtctgg

SEQ ID NO: 17275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catattgtgcaggcacgccgattgctctgatg

SEQ ID NO: 17276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catatttcgccagttgcgcggtgtagattacg

SEQ ID NO: 17277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaaaaatgaccccacgttgcaacaagat

SEQ ID NO: 17278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaaataacctgatcagggacatgaccac

SEQ ID NO: 17279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaacccctatattcggatatgtgttttc

SEQ ID NO: 17280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaagggcaagacttcaccggcctagttc

SEQ ID NO: 17281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaattcacatccggctgggcgcaagtgg

SEQ ID NO: 17282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaccgatgggccacgctttgtattggtc

SEQ ID NO: 17283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaactcgacgtacgggagtgctttgcttt

SEQ ID NO: 17284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagacttcgcttggacaatcagtctggg

SEQ ID NO: 17285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaggcatacttcgagcgactcatcagtt

SEQ ID NO: 17286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaggggcaactcctcgcatgccggggaa

SEQ ID NO: 17287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaaggggcgagctgagatactgctggttc

SEQ ID NO: 17288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagggtggagctcatgcagtgccgtcgg

SEQ ID NO: 17289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtaacattcccatggtcttcggtccg

SEQ ID NO: 17290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtacggtgtctcacggagggctcgtt

SEQ ID NO: 17291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtcaccgatacttacggccaggcctg

SEQ ID NO: 17292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtcgaagcgtaactgtccctccaatt

SEQ ID NO: 17293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtcgcgcattcttttggttgaccagc

SEQ ID NO: 17294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtcggaataacactacgccggcatcg

SEQ ID NO: 17295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaagtgtagttggctacgtcgacggcgcg

SEQ ID NO: 17296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaatccggaagcacggatcccgctagccc

SEQ ID NO: 17297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaatcgctcactcactgacgtcgcgttct

SEQ ID NO: 17298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaatcttgagcggtggtctgagcccggaa

SEQ ID NO: 17299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaatgacgaagataccccgggtaggttgg

SEQ ID NO: 17300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaatgcagcctctgtactctcagcatgtc

SEQ ID NO: 17301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaattctattaagttagtacatggcgcaa

SEQ ID NO: 17302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacaaatagcctgatcacactccacgtgt

SEQ ID NO: 17303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacaagggcaatcaactcattccgtattg

SEQ ID NO: 17304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacaatgccctggtgtgaatgtttcgggc

SEQ ID NO: 17305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacacagtagcgcgcgagatgtgctggaa

SEQ ID NO: 17306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacaggactaccggtttcgcgccccaagc

SEQ ID NO: 17307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacaggtacgtgcacaaatggtctcttcc

SEQ ID NO: 17308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaccagcgctgacgggtttgggtttttcc

SEQ ID NO: 17309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaccggaggcctcgtgctccctagctcac

SEQ ID NO: 17310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaccgtcatacgaaagatggaactacgag

SEQ ID NO: 17311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacgcagactcactcgagtggggaaaagg

SEQ ID NO: 17312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacgccgtcgcgtacttttgcatactcgt

SEQ ID NO: 17313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacgcgtgaatatggatgcgggctgcatt

SEQ ID NO: 17314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacggggagcttcggaactggttctccgc

SEQ ID NO: 17315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacgtggggcgcggaactcttcgtagccg

SEQ ID NO: 17316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactacacattcctcctctcgtggggccc

SEQ ID NO: 17317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactacgccctgatcgttccctggtccgt

SEQ ID NO: 17318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactactcggctcccacttcttttgcttc

SEQ ID NO: 17319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactaggagaccgtgtcggggactaagcc

SEQ ID NO: 17320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactaggttttgcgctgaacgtcaggaga

SEQ ID NO: 17321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcactcggtcctgatctgaaccttatattg

SEQ ID NO: 17322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcacttggtacctgcgggctggcgtgtgcg

SEQ ID NO: 17323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagaagttcttataacactccggggacct

SEQ ID NO: 17324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagacccttacgtatgaccactttgcctc

SEQ ID NO: 17325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagagtattaggcacgcgaccgcggttgg

SEQ ID NO: 17326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagatattctatcattttgccgcgacgag

SEQ ID NO: 17327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagatgcattctctatgggatgggcacga

SEQ ID NO: 17328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagatgcgagcccaatttgcgtccgactc

SEQ ID NO: 17329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagcaaatttacatcctttatctctcacg

SEQ ID NO: 17330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagcaagtgcgcttccttccgggttgcca

SEQ ID NO: 17331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagcactgttcaactttctcgatttaccg

SEQ ID NO: 17332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagcccttccaaggcgccatcaaggaggc

SEQ ID NO: 17333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagccgggatctacctgtccgtggtcgcc

SEQ ID NO: 17334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaggcagacggacacgcgcgtactatgtg

SEQ ID NO: 17335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaggcgagtaaaacgggcgcatgactacc

SEQ ID NO: 17336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaggggatctggcgaccaaagccaggcgt

SEQ ID NO: 17337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcaggggtcgtaggcattaattcgggtgcc

SEQ ID NO: 17338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagggtggaacatgggccaggctaaggtg

SEQ ID NO: 17339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtacatctcgcggagctcaccaattgc

SEQ ID NO: 17340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtatccacccgctgagccaatgtcggc

SEQ ID NO: 17341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtcaaactcctgcgtttctccgggcat

SEQ ID NO: 17342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtcaaatcacggccgtttgagcgcgat

SEQ ID NO: 17343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtcctgtcaaagcctatatgttcatcc

SEQ ID NO: 17344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtcgatttcggcctctacggatggttc

SEQ ID NO: 17345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtgcacttcattaacaccctacaaatc

SEQ ID NO: 17346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagtggcatcacgacatttgttccaggtg

SEQ ID NO: 17347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagttaccgtaacgtaggcgatattgtcg

SEQ ID NO: 17348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagttactcgccatggctgtctcttctcc

SEQ ID NO: 17349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagttcaacggtttgtgtttcttatatgg

SEQ ID NO: 17350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagttcgtatggtagcccctccatctact

SEQ ID NO: 17351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcagttggtagttgttctgaactaaggtac

SEQ ID NO: 17352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcataggcctactactgatattgcacttat

SEQ ID NO: 17353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatatgatatctattctgtcatatgggtg

SEQ ID NO: 17354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatcattcggaagtgtctggcttgtttgc

SEQ ID NO: 17355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatccctatctgccgggggttcgatcact

SEQ ID NO: 17356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatcgccggactgactaacgatccagtat

SEQ ID NO: 17357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatgataagttagaatggttccacttgtg

SEQ ID NO: 17358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatgctcctttggactccatgtcagtggc

SEQ ID NO: 17359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatgggagacggctgtgtttcatcttccg

SEQ ID NO: 17360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatgggcgctgtcttttcgacacttgtgg

SEQ ID NO: 17361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcatgggttgtgcatgcttagggcggatgg

SEQ ID NO: 17362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcattagagtttatcaggcctagtcaactt

SEQ ID NO: 17363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcattccaacgtcatgtcatccgtttattc

SEQ ID NO: 17364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcattgcgcgactaactgcccacgttgact

SEQ ID NO: 17365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcattttactccgcactgctgatggagcct

SEQ ID NO: 17366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaaaggtaagggtcatagtcatttggac

SEQ ID NO: 17367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaacaaggttagtcgactctcctatttt

SEQ ID NO: 17368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaaggtaggccagcgcagcgtgtctcgg

SEQ ID NO: 17369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccacagtgtaaatccgcaggccgtccttc

SEQ ID NO: 17370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccacccgattgaatttttatctgacgcgg

SEQ ID NO: 17371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaccgcctccctcacgacgcggttctgg

SEQ ID NO: 17372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccacctcctcgcagacttcgccctgttgt

SEQ ID NO: 17373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccacgggaagggccggttcagagcttaat

SEQ ID NO: 17374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccacgtcgtcggcacagagccttgttttg

SEQ ID NO: 17375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccactgccatggtctgggtgtgcacgcgt

SEQ ID NO: 17376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccagatctatagctatgcggctgcctctg

SEQ ID NO: 17377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccagcctgagtgattttttgagcattcac

SEQ ID NO: 17378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaggatacgctcgattttgtaattctct

SEQ ID NO: 17379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccagggacgattaatacgcctggctacac

SEQ ID NO: 17380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccaggggttaaagtacaccttatacgccg

SEQ ID NO: 17381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccagtggtgtggacagtgcttcgggcata

SEQ ID NO: 17382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccatatcgagggactaattccattctcgc

SEQ ID NO: 17383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccatatctttgtcgtcgtcgggcagctgg

SEQ ID NO: 17384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccatcggctacactcaagcccgtcctcct

SEQ ID NO: 17385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccatcggtattgctttgaaatcttagtgg

SEQ ID NO: 17386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccattaaggggttgtcctccgtgcgttta

SEQ ID NO: 17387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccaggctcagtcgaatgaagacagttct

SEQ ID NO: 17388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccatgaagtggtattagctggcttgcac

SEQ ID NO: 17389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccccgataaaaggcgcccttggtctgca

SEQ ID NO: 17390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccccgacctgtaacgacgataaggactaa

SEQ ID NO: 17391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccccgagtacgttttgagccctagggtgg

SEQ ID NO: 17392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccccgcggtttactcatccgttatactga

SEQ ID NO: 17393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccccgcttaagcactgactcattccaagg

SEQ ID NO: 17394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccccggagcacaatcttacggtcgaggtg

SEQ ID NO: 17395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccctggtttttccgtatgctggtgtatc

SEQ ID NO: 17396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccgactcttcgtaggacccaggcattgt

SEQ ID NO: 17397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccgccccgttatgcagcaaggtgcgcct

SEQ ID NO: 17398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccggtatctttgcttcgtgtagaaacga

SEQ ID NO: 17399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccggtatggccacagaaagcttttccat

SEQ ID NO: 17400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccggttatactacgtttagcaatgagac

SEQ ID NO: 17401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccgtcgctcctgaacgtgctcgactaat

SEQ ID NO: 17402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccgtgtgcgttgagatttaacttgcgaa

SEQ ID NO: 17403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccctagtcacccgtacagacagagctgtc

SEQ ID NO: 17404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcccttgggctcatgcctggcgcggactcc

SEQ ID NO: 17405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgaacggtgcataggacgtaggcgggca

SEQ ID NO: 17406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgaagaaccagcgtggcggtgtggcggg

SEQ ID NO: 17407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgaaggtagagcggggggacagtcggac

SEQ ID NO: 17408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgactctctcgcatgtatcctcatcggt

SEQ ID NO: 17409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgaggatcgcaggctaccctgcagctat

SEQ ID NO: 17410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgagtattaacctaggtggtattcggcg

SEQ ID NO: 17411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgatactgtgtgatgggaactggtttcg

SEQ ID NO: 17412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgatcatatcttgaatagtgtcggtgac

SEQ ID NO: 17413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgcaatgtgcactgaacaatcagaggcg

SEQ ID NO: 17414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgcccagcttccccgcgctgctattcga

SEQ ID NO: 17415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgcctgcaaagattaccgactgactttt

SEQ ID NO: 17416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgcgtccccctgaagccacgctggcgtc

SEQ ID NO: 17417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgctactgattcgcagcttgctgtcaat

SEQ ID NO: 17418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgcttagatctctgtgtacctagtcgct

SEQ ID NO: 17419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccggaactcgaacccgattcgaccaggtc

SEQ ID NO: 17420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccggcggcgagctgttcagcacctggact

SEQ ID NO: 17421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccggcttgaagacggagtcagcatgcggg

SEQ ID NO: 17422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgggagggggcctacgtggcgtcctgtg

SEQ ID NO: 17423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccggggcggtatcgatcggggggctgatt

SEQ ID NO: 17424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccggtaatgccatgcaacgtctagggccg

SEQ ID NO: 17425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgttaagagaaggggccgcggagtagct

SEQ ID NO: 17426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccgttatttatactcccagctgaaactac

SEQ ID NO: 17427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctaatgaagagatgatgatctgcgaatc

SEQ ID NO: 17428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctagacatcgcctggcgtccaccttatg

SEQ ID NO: 17429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctagccatgttaagtcattggtcgtaca

SEQ ID NO: 17430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctcgaaattgtgggaaatgtctgctcct

SEQ ID NO: 17431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctcttaaaccgtaccgacttaatctggc

SEQ ID NO: 17432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgaaagctgaacctcaacggctaccgt

SEQ ID NO: 17433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgacgacccctgaggtctgctatcagc

SEQ ID NO: 17434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctggggtaaggttatcggtgacccgcac

SEQ ID NO: 17435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctggggttttattcatttccgcacctgt

SEQ ID NO: 17436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctggttagaactagtcggatccctcgtc

SEQ ID NO: 17437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgtaccgttgttatctcgcttgtggcc

SEQ ID NO: 17438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgtagaattagtcacatacttttggct

SEQ ID NO: 17439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgtgaggttcctttggctgcagcccct

SEQ ID NO: 17440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgttgccaatcggtgggaggtaatgac

SEQ ID NO: 17441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcctgtttgagttactcgggacatttttgt

SEQ ID NO: 17442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccttacctaagtataagaagtgttttacg

SEQ ID NO: 17443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catccttattcgggatttaatggcatagggcc

SEQ ID NO: 17444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaaactcaggacgaggtttagcttaagt

SEQ ID NO: 17445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaaagcggggaaatgcgagttgcatagg

SEQ ID NO: 17446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaaatcccctacggcccaaacactcgat

SEQ ID NO: 17447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaacggatcgatccaccgttgctgttgg

SEQ ID NO: 17448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaactctttaaccgaccgattgttgtcc

SEQ ID NO: 17449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaagggataggaaaaggctttggtatac

SEQ ID NO: 17450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgacagcgtccgcggcgcctagagatgtg

SEQ ID NO: 17451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaccacgaaggagtgcagtggagcgatc

SEQ ID NO: 17452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaccgtggaaagtctgattcgtcttttg

SEQ ID NO: 17453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgacgcttcttactttttttctgtagagg

SEQ ID NO: 17454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgacggtccgacagcgtttcgcacggtgg

SEQ ID NO: 17455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgactgaaacggaaataaaattcctctag

SEQ ID NO: 17456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgactgtattgtgctgacccagaggctgc

SEQ ID NO: 17457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgagaggatgggatatcagcctgggttgc

SEQ ID NO: 17458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgagggtgttcacggcattatgttcaccg

SEQ ID NO: 17459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgaggtatcacgtcaaatatctgcctcgg

SEQ ID NO: 17460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgataatcaggtggtgcgctgcctacacg

SEQ ID NO: 17461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgatacggtccgaaaagtgtacggactac

SEQ ID NO: 17462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgataggccgtaaagtagggggtagtgaa

SEQ ID NO: 17463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgatcgcaggggcacctattcggatagct

SEQ ID NO: 17464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgatcgttacgttctcgtcccgtcccgtc

SEQ ID NO: 17465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgatgagtatggaggctttcgagacgtac

SEQ ID NO: 17466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgattacggctaggtcacccggatcagct

SEQ ID NO: 17467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgattgcggcagctattatttccgcctta

SEQ ID NO: 17468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcaaggcatcgtttggtcactgtagttt

SEQ ID NO: 17469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcaaggcggattgtccgcacgctgcctg

SEQ ID NO: 17470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcaatgctactcgccgatcggttccgtc

SEQ ID NO: 17471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcacattggagatggcatatagagtgac

SEQ ID NO: 17472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcacgacttttcacctggttcatgattc

SEQ ID NO: 17473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcactggaccgttgggattcgtcccttc

SEQ ID NO: 17474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcagaacagttgtgtcctcctcccagcc

SEQ ID NO: 17475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcagatcaaggccttagggcgtcggtta

SEQ ID NO: 17476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcatagtaatcaggggtcgcgatccggt

SEQ ID NO: 17477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcatcgacctccgtggaggggactcgtt

SEQ ID NO: 17478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgccacctcccgcttccccgtcctcgcgc

SEQ ID NO: 17479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgccatagcatcgacgttatctacggggc

SEQ ID NO: 17480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgaatccccgtctggcgagctccaact

SEQ ID NO: 17481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgcgaacgatgtcaccgccctggacta

SEQ ID NO: 17482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgcgtgggtaacgtaacagtttctcgg

SEQ ID NO: 17483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgctgaactaaattgtcgtgcagggtt

SEQ ID NO: 17484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgctggccggatacgaagtgggtatgg

SEQ ID NO: 17485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcggcaaacaccatattccggaggtcga

SEQ ID NO: 17486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgggaaagtggtgttccttctggtttt

SEQ ID NO: 17487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcgtatcaccctactattttgctgttgt

SEQ ID NO: 17488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgctatggccctaggtcgggcgacgagac

SEQ ID NO: 17489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgctatgtgccgccccttttgatgtcact

SEQ ID NO: 17490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgcttagccgtaagccgagtatcccgcgt

SEQ ID NO: 17491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggaatcggagaccctcggcatcagcctg

SEQ ID NO: 17492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggacaacgcggactttcgcctatgttcg

SEQ ID NO: 17493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggacctgctgattagatccgctatattg

SEQ ID NO: 17494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggacctgcttgttcaaagtttcttgctg

SEQ ID NO: 17495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggagcaacttgttgtaccttactcctac

SEQ ID NO: 17496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggaggaggacgcgatgataccggcccga

SEQ ID NO: 17497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggatccttgacacggatcagttactttc

SEQ ID NO: 17498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggatcgtcgctgtccaatcactcggtcc

SEQ ID NO: 17499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggatgcggggaggtcttaggggacttcg

SEQ ID NO: 17500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcactcgtggggacggtgggcctgtgc

SEQ ID NO: 17501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcagaagttacaacgggtcgcaggatt

SEQ ID NO: 17502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcagcgagagtcctcgtatcgcttact

SEQ ID NO: 17503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcagtaaggttatgcacgcgtgataaa

SEQ ID NO: 17504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcccctatttctatcgtggtacgatta

SEQ ID NO: 17505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggccgggtcgtaccctggctatcgctaa

SEQ ID NO: 17506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcgacacagaaggtgtggcaggacgtt

SEQ ID NO: 17507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcggccgtcgaagcaacagagttagag

SEQ ID NO: 17508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggcggcgtgcaatctagtagtctgaccg

SEQ ID NO: 17509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggctccagaacagatcttcagggcatcg

SEQ ID NO: 17510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggctcggactcgataaaaccgagtttcc

SEQ ID NO: 17511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggctgcatggtcctctgaggcatagggt

SEQ ID NO: 17512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgggatcagaacggtgttcggtcggcata

SEQ ID NO: 17513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgggcaggcgactctaatccggacactcg

SEQ ID NO: 17514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggggtagagagcttgcttagacaaagcc

SEQ ID NO: 17515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggggtgaattccttgcgctcgtggatcc

SEQ ID NO: 17516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggggtgctcgtgggtaggtttacccttt

SEQ ID NO: 17517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggggttcaaggaacaagataccgaaggg

SEQ ID NO: 17518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgggttgccgagataccagcgatgcggga

SEQ ID NO: 17519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggtacgatacatatagtcggtattcacg

SEQ ID NO: 17520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcggtgaggccgatggtcaatagcgcaggt

SEQ ID NO: 17521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaagtgttgccccgttgggctgtcact

SEQ ID NO: 17522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaatcccgaactggtccttgttggcgg

SEQ ID NO: 17523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaccacatgagagcaaggactggcgtc

SEQ ID NO: 17524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaccagcgtctcctgattttgcacccc

SEQ ID NO: 17525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtagaccgcctcctaaactggcaggccg

SEQ ID NO: 17526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtagcgtgccaggcttggtaccgcgtgt

SEQ ID NO: 17527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaggagcacgacgtcacgccacataat

SEQ ID NO: 17528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtaggcgcaatcacaccgcggtctcggc

SEQ ID NO: 17529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtatccgttcggctggagtctgggcggg

SEQ ID NO: 17530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtatctttgtcgcggtccgatggtatgg

SEQ ID NO: 17531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtcaaaggttatgaactagttggcatca

SEQ ID NO: 17532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtcacccactcgccttgtgtttcctgtt

SEQ ID NO: 17533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtcatactcagctggagttgtgtgtgtg

SEQ ID NO: 17534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtcattggcatgttccgcgcggcggatt

SEQ ID NO: 17535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtccgacgagggggcctcgatctaagag

SEQ ID NO: 17536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtccggccggatgaatctccgcgtggct

SEQ ID NO: 17537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtccttgtttgaataacttggcgcgcgg

SEQ ID NO: 17538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtctagagggagcaaagacctcgtgccg

SEQ ID NO: 17539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtctctcgggaccttatcttcgagcagc

SEQ ID NO: 17540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtgatgtgcaccccaccgcaaacctctc

SEQ ID NO: 17541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtgccttaagcgctcggggagatcgtcg

SEQ ID NO: 17542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtgctcatacagcggatagaccattggg

SEQ ID NO: 17543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtggacaggacagccgggtgtgggcaga

SEQ ID NO: 17544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtggctgcagtagtcggattagcatgcg

SEQ ID NO: 17545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgtgttttggccagtgagcgcgtatgttt

SEQ ID NO: 17546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcgttttggcgtcctacgagccgttgcctg

SEQ ID NO: 17547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaagacttgctcgtagtccactgccgta

SEQ ID NO: 17548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaagcggtggtgtcgggcatgtcgagcc

SEQ ID NO: 17549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaatccggtcccttctacatgctgtgtc

SEQ ID NO: 17550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacagtccctttttttgtatggtcatca

SEQ ID NO: 17551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacccagggctacgtagtctgatgcgct

SEQ ID NO: 17552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacctcccgctggtttcatagtattgag

SEQ ID NO: 17553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacgggaagtttagtccgccttgatgct

SEQ ID NO: 17554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacgtgtgtcgtacgtcactgaaaactc

SEQ ID NO: 17555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctacttgtcctcagcctccccgctaccta

SEQ ID NO: 17556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctagacggtgctctctactgcatgagcga

SEQ ID NO: 17557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctagagcaatcgggttctctctttcatca

SEQ ID NO: 17558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctagatgaccgtatccgcaccgcacatca

SEQ ID NO: 17559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctagcgcgcatgttcggaggaagggtgtt

SEQ ID NO: 17560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaggatacaggcatgtactctgacgttt

SEQ ID NO: 17561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaggtctgctggatagtcgatcggacgg

SEQ ID NO: 17562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctaggtttcaattgctcatctttattgct

SEQ ID NO: 17563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctagttgcttcgttcatgccacagtcttg

SEQ ID NO: 17564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctatgagacagtcaaagtgagcgtggtgg

SEQ ID NO: 17565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctatgcggttgccggacgtgtcacaggcg

SEQ ID NO: 17566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctattcaagtagattctggacgcgctctg

SEQ ID NO: 17567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcaatacgtgccaatgtttcccgttcgt

SEQ ID NO: 17568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcattatgttgcccgcgccccttggggg

SEQ ID NO: 17569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctccaactagccggtccgtgtagtgtggg

SEQ ID NO: 17570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcccggggcggctcctcatttaactcgt

SEQ ID NO: 17571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcccgtaacgatcttcacacgagttgtg

SEQ ID NO: 17572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctccgtgtcggttggcctatcgctaggta

SEQ ID NO: 17573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcctgctccttaggcgatagtttagtcg

SEQ ID NO: 17574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcctggtgcacggacggtaacttcgcgc

SEQ ID NO: 17575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcgactagcagtaattgctccttttccg

SEQ ID NO: 17576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcgctcggcggcattgcgagtattacgt

SEQ ID NO: 17577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcggcatctcttgtgaggcgtcctctgc

SEQ ID NO: 17578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcggttagcacgactcggtaaattaggt

SEQ ID NO: 17579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcgtgggacgccgtctcctgacttacgt

SEQ ID NO: 17580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctctcacggagtctgcaggtagtagttgg

SEQ ID NO: 17581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctctcgggccacataagccttagtccgta

SEQ ID NO: 17582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctcttgtgtccatgggcgcggctgtcctt

SEQ ID NO: 17583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctctttttggtgtttatcgtcggtgtgtc

SEQ ID NO: 17584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgaaatgcgtaatatgggtcggacgcga

SEQ ID NO: 17585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgacggcaacgggaggtcgtcctggctt

SEQ ID NO: 17586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgcacactcagctgacacggttgttcgg

SEQ ID NO: 17587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgcacgtgtatcatcaccacagcaggcg

SEQ ID NO: 17588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgccgccgatctcctgttggatgggtgt

SEQ ID NO: 17589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgcctccgtgctcataactgtattcgag

SEQ ID NO: 17590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgcggatggaatacgaggagagataagc

SEQ ID NO: 17591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgctcagccatggggtcaaagcctggtc

SEQ ID NO: 17592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctggcgggtgggtcactttggataacgcg

SEQ ID NO: 17593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctggggtgtgttcgcgaagagcctgattt

SEQ ID NO: 17594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtagtgtgatacttatgcgccctattg

SEQ ID NO: 17595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtatgttgtgctctggaagttcacccg

SEQ ID NO: 17596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtcacatgtttatctcaggtgtttctt

SEQ ID NO: 17597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtcatccgccttgtgatcgtggggtag

SEQ ID NO: 17598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtcgacatacgcaattttagcccttcc

SEQ ID NO: 17599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtcgggaggcctcttcattcggcgatg

SEQ ID NO: 17600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctgtgtcgcagagtagcgattctaaggcc

SEQ ID NO: 17601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttacgactcttcttttcccgctacacca

SEQ ID NO: 17602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttaggcggtgttctgacttgcttcacct

SEQ ID NO: 17603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttccacttggttttaaaagtatgtgttt

SEQ ID NO: 17604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttggtgcagtcaatcagttgtcaacggt

SEQ ID NO: 17605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttgtcagccatctatgcagcggcctttc

SEQ ID NO: 17606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctttaaaaatgcactcgctccagatactg

SEQ ID NO: 17607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctttaatttggattttggccgactcctac

SEQ ID NO: 17608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctttactttgttttcttgtcgatgtacca

SEQ ID NO: 17609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctttgtgggcaaccatgacatgttgcatg

SEQ ID NO: 17610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catctttgttccatctgtctccatttgagtgt

SEQ ID NO: 17611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catcttttaattacgcgatttcccccacctgc

SEQ ID NO: 17612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaaaacggctgattctctcgacagcgggc

SEQ ID NO: 17613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaaagcgaaaaactgttggggtagggtgg

SEQ ID NO: 17614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaaatacggccgtcgttgcgttcttgcac

SEQ ID NO: 17615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaacactggcccaggactctcggaagcgt

SEQ ID NO: 17616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaaccgctagaagccacataaagaacgga

SEQ ID NO: 17617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaacggacgatgaggcccgcttgtcagta

SEQ ID NO: 17618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaactcactgtagccagagtatgaatcca

SEQ ID NO: 17619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaagcagcgggtcattgaagatcggtcca

SEQ ID NO: 17620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaagctagcttcttcactgtgaaacgtgt

SEQ ID NO: 17621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaagtgttgagattaagtggttatacccg

SEQ ID NO: 17622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaagttgcacgctcattttgatatcctag

SEQ ID NO: 17623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatatcgaaaacgcggggcttaggagta

SEQ ID NO: 17624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatcgaatttgttgagtcatctcgcgtt

SEQ ID NO: 17625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatcgctctggcacagataggctggaat

SEQ ID NO: 17626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatgaccgtaaagactatctacgtggtc

SEQ ID NO: 17627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatggtagtcgtttgcccccatttcgtt

SEQ ID NO: 17628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatgtgttgaaggatatgggtgcacgcg

SEQ ID NO: 17629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaattagatttcggcgcggtgccccacgt

SEQ ID NO: 17630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaattctagctgaggtgctggcttttttc

SEQ ID NO: 17631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaatttgacgttgctcggtggttaggtgg

SEQ ID NO: 17632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacaccccgaagtcgcggacgtaagtcct

SEQ ID NO: 17633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacactgtcctctcgatcagggctgcttg

SEQ ID NO: 17634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccacgggcttgggaatcggtgcacgta

SEQ ID NO: 17635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccatcgttggccaccgcgtaaattgtc

SEQ ID NO: 17636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacccatggcccaaggcggcacggtcttg

SEQ ID NO: 17637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccccacgagcagggactgcgaacgttc

SEQ ID NO: 17638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacccgcgatctcgaatcgtattgcacgt

SEQ ID NO: 17639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccgggcgcggccgtgaaaatgtgccgg

SEQ ID NO: 17640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccggtaagtctgtaactaagtctaatt

SEQ ID NO: 17641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccgtcctttagtttaggggcaggttgt

SEQ ID NO: 17642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaccttgagattcaatgccccctcgaccg

SEQ ID NO: 17643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacgacctgatcacacgcggatcggtacg

SEQ ID NO: 17644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacgcagcctgagctaactactaatgaga

SEQ ID NO: 17645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacgccgagtgcgtgtgtgagcgcttcac

SEQ ID NO: 17646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacggcgaggctttgttttggacttttat

SEQ ID NO: 17647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacgggggccgggaaataatggactcgtg

SEQ ID NO: 17648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacgtctagtcgtgtatccagtgtatctc

SEQ ID NO: 17649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactccgcggctgttggtccgagtttggg

SEQ ID NO: 17650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactcgatgaggcgtgaaggtggctgtgt

SEQ ID NO: 17651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactcgcaaaggcatcacgcgcctactcg

SEQ ID NO: 17652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactctgtgcccttcgcaggggtcttgtt

SEQ ID NO: 17653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactggatctgcatgacactgtgacgagc

SEQ ID NO: 17654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgactgtcgcgaagacgatcacagcggggt

SEQ ID NO: 17655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgacttacactgtcgacttatgttcgattc

SEQ ID NO: 17656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagacagtgactgaccgccgcatgtaccg

SEQ ID NO: 17657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagatctccacaactttcggtggcctgca

SEQ ID NO: 17658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcaaccaggcacacacaataaaccacc

SEQ ID NO: 17659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcacagtagagttcgtgcgtcagtacg

SEQ ID NO: 17660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcacgaagagatgggcagctttcttga

SEQ ID NO: 17661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcaggcggccagcttagaagaggcgcg

SEQ ID NO: 17662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcgtcctagtgaaggtttgtctgcggc

SEQ ID NO: 17663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagcgttgttgaacgcacccggggaggac

SEQ ID NO: 17664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggatagattatgttagtttcgctaaaa

SEQ ID NO: 17665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggcacagtccctcgcttctatgaggac

SEQ ID NO: 17666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggcgattgtccctgggcttttgtagcg

SEQ ID NO: 17667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggcggtcacgaccgcagttgctgcctt

SEQ ID NO: 17668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggctacatagatttttagcttatgttc

SEQ ID NO: 17669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggggctgaccgctatgcgacgcggcgc

SEQ ID NO: 17670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgaggttgacccagggggatcggctgccgt

SEQ ID NO: 17671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagtacgtcgtgtacggtttgtgaatgtg

SEQ ID NO: 17672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagtatggcgcgagcaagatgtcttcagg

SEQ ID NO: 17673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagtggcttgtggtgtcttcctgtgtacg

SEQ ID NO: 17674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagtgggttcagccagtttatctttccct

SEQ ID NO: 17675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgagtttaccggaacagctgaggtcgtgtc

SEQ ID NO: 17676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgataaactggctcacccactctctgtctc

SEQ ID NO: 17677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgataacaagggagacgtccctctttttat

SEQ ID NO: 17678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgataagcgtaaatcggtgtgagagtcggg

SEQ ID NO: 17679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgataccgcgacttttgggtcctagtcaca

SEQ ID NO: 17680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatatgacatggggctaccactgtctcgg

SEQ ID NO: 17681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatcccttatacttcgtgggagccccgct

SEQ ID NO: 17682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatccgatatgctcttcttcttgggtggc

SEQ ID NO: 17683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatcctggcatatgtcctccgccacagag

SEQ ID NO: 17684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatcgcgataatcgtaaccagctccgcgg

SEQ ID NO: 17685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatcgctctttcatattcgtggcgcactc

SEQ ID NO: 17686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatctgccctttggctcgtcgcttaccgt

SEQ ID NO: 17687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatctggtcagccatgggtagtagggtcc

SEQ ID NO: 17688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatgatagggacaagaaagaatttcctgc

SEQ ID NO: 17689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatgcaggagctagtgggacaatacatga

SEQ ID NO: 17690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatggatatgttgtactcctaacgtgtaa

SEQ ID NO: 17691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgatgggtgctcttttcgcgtgtttatttc

SEQ ID NO: 17692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaacacggctattcaatagcgcggtgtc

SEQ ID NO: 17693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaagagcgctggactactctgcaattca

SEQ ID NO: 17694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaatcctcttgttacgacctcggggttg

SEQ ID NO: 17695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaattaggctagtggtcctttttggacg

SEQ ID NO: 17696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcacattatctactccctggggtcttgga

SEQ ID NO: 17697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaccattagttgggttgtgggtgacgct

SEQ ID NO: 17698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcacgcagcgcttaagggaatggaaaatc

SEQ ID NO: 17699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcacgtccgacaactcgctttgattgggg

SEQ ID NO: 17700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcactcctcttgattcatttgctccgttc

SEQ ID NO: 17701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcactcgaatttagtggtgtttggtggcg

SEQ ID NO: 17702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcacttaacttggggcaggactgtgtggt

SEQ ID NO: 17703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcagcgaccgtatatttgagcgtgagttt

SEQ ID NO: 17704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaggcactgtgtggttagcgatgctatc

SEQ ID NO: 17705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaggccgcttgctgtacgtaccgggtgg

SEQ ID NO: 17706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaggtatgacaggattgttatagaattg

SEQ ID NO: 17707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcaggtgcaccgaaggccggagggtcgga

SEQ ID NO: 17708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcatcaactgggatttgttgaccgcgact

SEQ ID NO: 17709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcatcggtaactagcctctacgcggtcct

SEQ ID NO: 17710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcatctcctaagcacgatacaaaatggct

SEQ ID NO: 17711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcatgcaggcaggttctggggtcggctgc

SEQ ID NO: 17712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcatgcgagacgaccgggacattaggtcc

SEQ ID NO: 17713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcattcaatcatacgctgtcgatctaagt

SEQ ID NO: 17714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcattctcacgagactactttaccaccct

SEQ ID NO: 17715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccacactcagatccgtttcgtccttgct

SEQ ID NO: 17716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccacggggaaggaaccagcacaagttcc

SEQ ID NO: 17717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccactctgtttgtgtacctattaccgtg

SEQ ID NO: 17718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccaggcgaatgtgttcttttgcatctgc

SEQ ID NO: 17719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccctagatgtcgtttcgcggaaagccc

SEQ ID NO: 17720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccccttgcctagctgcggtctgacatct

SEQ ID NO: 17721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgagagatcggttctggagatctatt

SEQ ID NO: 17722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgagtccataattgtatcgttagtct

SEQ ID NO: 17723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgcgctcagtcactgcgtagttattc

SEQ ID NO: 17724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgcggccattgcagaactggaataag

SEQ ID NO: 17725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccggggaggtcaagttggcttggcatg

SEQ ID NO: 17726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgtatgacggctgggccctgctccac

SEQ ID NO: 17727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcccgtcacaacttggtccggaaacgtgt

SEQ ID NO: 17728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccctgaagggggatacttcctaaggtct

SEQ ID NO: 17729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccgagtcgagcatcagatgttcttcgtg

SEQ ID NO: 17730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccgatctgctgtaaggggtctttcgacg

SEQ ID NO: 17731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccgcatgctattggttcatcgggcgttt

SEQ ID NO: 17732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcctcatggtgcacgccaatgcgaagtgc

SEQ ID NO: 17733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcctgcgaaacggcatcagcttaccaatc

SEQ ID NO: 17734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgccttctgctaaagctattatcccgatga

SEQ ID NO: 17735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgaaacagaacccgtggttagtgcttct

SEQ ID NO: 17736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgaactcgaggctcatagcgcttcgtac

SEQ ID NO: 17737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgaagacatgtcagttatcgacagcggc

SEQ ID NO: 17738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgacagctaggtcaacaccgcggggctt

SEQ ID NO: 17739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgacgaataccatcgcggaggatcggct

SEQ ID NO: 17740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgactcttgactccagcctctggaaact

SEQ ID NO: 17741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgagggcggctaagcgatactttcttcc

SEQ ID NO: 17742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgatagtgtcgccggacgttcacggctg

SEQ ID NO: 17743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgatcagagaagtcacgactccgtgttg

SEQ ID NO: 17744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgattgaggacataacccagttatcgta

SEQ ID NO: 17745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgcagcacgccggttttgcgtgttagat

SEQ ID NO: 17746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgcaggaatgtgaaggctattcgggtac

SEQ ID NO: 17747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgcgaggctgcacgaaagtcgggtgtgc

SEQ ID NO: 17748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgcgcgcatctcgggtgttttcgccacc

SEQ ID NO: 17749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgctcggatctatatttccttggaagcg

SEQ ID NO: 17750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggaacactgttgagaatcgtacacatg

SEQ ID NO: 17751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggaccgcctgattcgccgaaagcgtta

SEQ ID NO: 17752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggcacacagaggttcaccagtgttagc

SEQ ID NO: 17753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggccaagatccaactttatttacgtcg

SEQ ID NO: 17754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggccgcttaggtaaggtatacggcgcg

SEQ ID NO: 17755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggcttccagtctgcctctgctcgagtt

SEQ ID NO: 17756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgggacagtggcaagtaccagcctggga

SEQ ID NO: 17757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgggcatgaagcgtcgttacgggcagaa

SEQ ID NO: 17758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggggaagtagagagggcgggttaaggg

SEQ ID NO: 17759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggggccacgggtacacccatttccagt

SEQ ID NO: 17760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgggtacgagcacaattcacatggccgc

SEQ ID NO: 17761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgggtattgacaatgttttggggtggcg

SEQ ID NO: 17762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggtagtacaagaataatttgctgcgcg

SEQ ID NO: 17763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcggtcaggcacgaaccgtcttgtgcagc

SEQ ID NO: 17764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgtaaccggtgggtggaaagcgaagttc

SEQ ID NO: 17765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgtatgtgtgatttttgagttccggcac

SEQ ID NO: 17766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcgtcgtatcttgttcggagttagcgcgc

SEQ ID NO: 17767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctaaaaaatagaaccctgccgccgcttt

SEQ ID NO: 17768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctaactacgccagcgtggagtagaacgg

SEQ ID NO: 17769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctaatccctatcggcactagtaagggtc

SEQ ID NO: 17770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctaattctaaacattcatgttgtcaaca

SEQ ID NO: 17771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctacactccgttgagccggcaaatggct

SEQ ID NO: 17772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctacgaaacgacacggttgtcgccatgt

SEQ ID NO: 17773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctagtaagccacccttagtatgcgggtt

SEQ ID NO: 17774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctatcggttgggtatcacttccaggtct

SEQ ID NO: 17775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcaatatttacatgggctttcgtaacc

SEQ ID NO: 17776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcaatgtaaatgtctaaacatctgttg

SEQ ID NO: 17777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctccgcttaggccccaaatacaagtgcg

SEQ ID NO: 17778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcgatttggaagggtggttggagtgac

SEQ ID NO: 17779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcgccctgggcttctttcgcttccgtc

SEQ ID NO: 17780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcggactgcgaactagttcacgccatg

SEQ ID NO: 17781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcgggacgacagtgagcacgaacgccg

SEQ ID NO: 17782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctcttggtggtggcggtgtcgctgattt

SEQ ID NO: 17783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgaataccggctcagccaattccaggc

SEQ ID NO: 17784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgaattaagcaatttaatccgtgacac

SEQ ID NO: 17785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgacacgggacttcgttggtggcggtg

SEQ ID NO: 17786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgagttggagcgccattgatacgactg

SEQ ID NO: 17787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgatggtgtttatgcccaaagagtgtg

SEQ ID NO: 17788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgcagacccacgtcttgttatcgtcta

SEQ ID NO: 17789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgtatatttctagcctcttccggtggg

SEQ ID NO: 17790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgtgtggctattcccagaatgcatgtg

SEQ ID NO: 17791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctgttgcatctccgcccggaaagacttc

SEQ ID NO: 17792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcttagcttaccggatagacagacatgag

SEQ ID NO: 17793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcttgggtcataagcctgacgctgcgtct

SEQ ID NO: 17794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgcttgtgaggatgcgcgcgtatttcattt

SEQ ID NO: 17795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgctttgtctcacccccgtgctacatcccg

SEQ ID NO: 17796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaacacgttgcagtcgtcgtaccgcggt

SEQ ID NO: 17797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaaccatcagggtgctaccgtcttctag

SEQ ID NO: 17798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaacccatcttccgcggctatttctgtt

SEQ ID NO: 17799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaacttatcgcgtagtcctcccatggtc

SEQ ID NO: 17800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaagcccctttggtattcggctacatcg

SEQ ID NO: 17801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaatgagctttgggttgccgttcggccc

SEQ ID NO: 17802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaccacactgatcacatgtgcgcgattc

SEQ ID NO: 17803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaccttcccagctggcacccttttcgcg

SEQ ID NO: 17804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaccttggcccagttgagaccgtccagc

SEQ ID NO: 17805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggacgcgcaatctcaatgagtatcagctt

SEQ ID NO: 17806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggacggaccgcccgggattccgatgtgtg

SEQ ID NO: 17807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggacggataggtcgtgccctatagcgtag

SEQ ID NO: 17808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggacgtaaccgtttgggagagctcgttaa

SEQ ID NO: 17809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggactgctggatgctcgctaaatggacta

SEQ ID NO: 17810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagcaaattctgaagggatgaacttagg

SEQ ID NO: 17811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagcataagcccacgcacgtcatacata

SEQ ID NO: 17812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagcgatggttcctgcgaactgtgtaag

SEQ ID NO: 17813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagcttgaggaacttccaggggtgtttt

SEQ ID NO: 17814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagggggcgaaggttatgtaacgtcgcg

SEQ ID NO: 17815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggaggtaacagttagtttaacgcgcagtc

SEQ ID NO: 17816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagtagcgggcgcgcccgtccccgttgg

SEQ ID NO: 17817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagtagctgaatggcgctggactatagc

SEQ ID NO: 17818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagtagggggtaaagtgacgctgtagga

SEQ ID NO: 17819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggagtttgaatccattgcttctcgttgcc

SEQ ID NO: 17820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggataataatggtgcaggcagcccgctac

SEQ ID NO: 17821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatcactcagctcattccttgataatgg

SEQ ID NO: 17822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatcgatagggacacttagaattacgcg

SEQ ID NO: 17823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatcgttctacgggagcgtcgggttgtg

SEQ ID NO: 17824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatgtccaccggcgacttcctgacgatg

SEQ ID NO: 17825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatgtgaagggtttgtctcttccgtggt

SEQ ID NO: 17826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggattaaggagcgcagaaggcactcgcaa

SEQ ID NO: 17827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggattcaacccggtcttaacgcttctgtg

SEQ ID NO: 17828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggattctggatgtgatggctactgtgcca

SEQ ID NO: 17829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggatttgtcttggcaattgtgcggttcgt

SEQ ID NO: 17830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaaaacgttgattgaaaaccggttaat

SEQ ID NO: 17831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaacatctcggcaagtgatgcctccgc

SEQ ID NO: 17832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaacgtttaccggccagaggcagccaa

SEQ ID NO: 17833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaagttaagcattcaatgatatttcat

SEQ ID NO: 17834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaggagtggatacggttgtgggcactt

SEQ ID NO: 17835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcaggcggcttaccacgagttggtattg

SEQ ID NO: 17836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcattggtcgcgaactgcctcatggatt

SEQ ID NO: 17837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcattggtgagttctgccggtttgcgac

SEQ ID NO: 17838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccagggttagtataggtatagatagag

SEQ ID NO: 17839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccagtcgggacaatcctctcgtgtgtg

SEQ ID NO: 17840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccatcttagtcaaagaggcggtttgag

SEQ ID NO: 17841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccatgaatcgttcgcgctggtgctgga

SEQ ID NO: 17842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcccacgggtcgcattactggattggac

SEQ ID NO: 17843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcccgcggatttcgtacttgacgtgttt

SEQ ID NO: 17844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcccttccactcgcaggtgaagcaaccg

SEQ ID NO: 17845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccggactgcccttctggcgataccagg

SEQ ID NO: 17846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccgggcattcattcttattgtttcagc

SEQ ID NO: 17847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggccgtggtaagcaggtagaggtgccgag

SEQ ID NO: 17848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcctacgaactgtctgcgcgtctagtta

SEQ ID NO: 17849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcctcacagttctcgcgtccgtgccaag

SEQ ID NO: 17850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgaagcgtcagttgtgtctggttgtta

SEQ ID NO: 17851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgagcgtgtaccggttagctgtgcgcg

SEQ ID NO: 17852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgaggctataacgaggggaggacaacg

SEQ ID NO: 17853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgcccaaacgcgaattgtgtaatgccg

SEQ ID NO: 17854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgctctgggctgcacattccctgataa

SEQ ID NO: 17855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcggagttgtcgacgtttgatcatcaac

SEQ ID NO: 17856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcggcaaggaggttatcagttgctgttg

SEQ ID NO: 17857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcggttgggctgccaaaagcacatggat

SEQ ID NO: 17858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgtctggtccatcataacccgtcccct

SEQ ID NO: 17859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgtgcagagggagggcgtaaggaggct

SEQ ID NO: 17860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcgtgcagatattttgtggttcggcccg

SEQ ID NO: 17861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctaaaggtccaagttcagccggtaaag

SEQ ID NO: 17862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctaatgtgttggagtgcattaagtaca

SEQ ID NO: 17863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctagtgtcccgtggtttcgtggcagtg

SEQ ID NO: 17864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctcccgttcctccccgtgtcacctgtc

SEQ ID NO: 17865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctgaccagtgaagctaggatgtgaagg

SEQ ID NO: 17866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctggcaggtagaatctcgtatacagac

SEQ ID NO: 17867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctggcgtggaaacagcgttttctagat

SEQ ID NO: 17868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctggcttcgactaggccagatagacgt

SEQ ID NO: 17869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggctgttgaaccttccacccctcagtccc

SEQ ID NO: 17870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggcttttaacggtctaggtgcgctaggac

SEQ ID NO: 17871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggaacggtttgaggcgagctttgtaccg

SEQ ID NO: 17872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggaccatcatacgttgggctaccactca

SEQ ID NO: 17873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggacggacgaggtacgttgacgggtctg

SEQ ID NO: 17874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggagaacacttcatggtgacgaaatcat

SEQ ID NO: 17875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggagcacacatatcctccgcggcgccac

SEQ ID NO: 17876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggaggcaatgtctggactgtggggaggt

SEQ ID NO: 17877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggagggggtgctggtggagtcgacatgc

SEQ ID NO: 17878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggagtgtacggacgtgtcgttgggaatt

SEQ ID NO: 17879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggagttcagtagggggttttgctcacca

SEQ ID NO: 17880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggattctggtgacggtacaacgctgcac

SEQ ID NO: 17881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggcaaactaagctctcatttgcttgctg

SEQ ID NO: 17882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggcaacagggcgtggtgattcttaatgg

SEQ ID NO: 17883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggccattgatagcggaccggttgttttg

SEQ ID NO: 17884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggccgggcgtgacgttcagaggcgtgga

SEQ ID NO: 17885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggcgcgtcgattcattctattgaacatg

SEQ ID NO: 17886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggcggcgagtaagctgggtgagtactcg

SEQ ID NO: 17887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggcggtggtgggtaagtggtgtagtgct

SEQ ID NO: 17888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggaaaggatgcaaatctaccagggtac

SEQ ID NO: 17889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggacgaatcctacgtactctccgtagt

SEQ ID NO: 17890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggcaccgctgcgaatggggacgatcaa

SEQ ID NO: 17891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggcattacagacgtagcccgggcaccc

SEQ ID NO: 17892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggggggactgagcttgcccaattgcgg

SEQ ID NO: 17893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggggttcgaatgcagtcagttttcaaag

SEQ ID NO: 17894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggtacggggaacttgcttgacaggcgg

SEQ ID NO: 17895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggtgcctcttcgattcgctgctactcg

SEQ ID NO: 17896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggggtggacggtttcctcatagtgttgtc

SEQ ID NO: 17897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtaagcgtgatatgataatcggcttgc

SEQ ID NO: 17898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtagccctattgggtttcattgtccgg

SEQ ID NO: 17899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtctggcggggaagcgcggtcaatgtg

SEQ ID NO: 17900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtgaggtagattcaggatcagtgcact

SEQ ID NO: 17901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtgcggctgggttgagccatctgcgcg

SEQ ID NO: 17902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggttcagctggactggccgagttcgttc

SEQ ID NO: 17903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgggtttgacggcgcagaaggtgccatttc

SEQ ID NO: 17904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtaaaggaggcatgctaaccgtccagca

SEQ ID NO: 17905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtaaccacccgagacggcactgaacaca

SEQ ID NO: 17906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtaaccgatgagatcgacgtgtcgcggc

SEQ ID NO: 17907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtacactggggagtccagcgcgttcgct

SEQ ID NO: 17908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtacgccacgatcgccgagtggactagc

SEQ ID NO: 17909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtacttaatatcggttatccgcggtggc

SEQ ID NO: 17910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtatcgtaaggtttagcactgtcgaata

SEQ ID NO: 17911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtcagatatatgccaggtcgctggtggg

SEQ ID NO: 17912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtcagggaactccccgaccgagttaagg

SEQ ID NO: 17913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtccacttgccactttccttaagctatc

SEQ ID NO: 17914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtctcatattgctaactcgttataggtg

SEQ ID NO: 17915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtgaaggatcaacggccccggtaagtct

SEQ ID NO: 17916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtgagcgggacaagccgtggctctggtg

SEQ ID NO: 17917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtgcttccccgtgtcgtgttctggtagc

SEQ ID NO: 17918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtggaccaagacgtttcagctcttcctc

SEQ ID NO: 17919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtgtaggctgagcagttgccaatgcgag

SEQ ID NO: 17920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtgtggtatcagcgtacttcgactcgtg

SEQ ID NO: 17921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttagaaacgtcggcgccgacttatgtc

SEQ ID NO: 17922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttattcgagattgttcccattctcgat

SEQ ID NO: 17923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttgcacccggctcggataacctgaggg

SEQ ID NO: 17924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttgctcgaggccttttatcggtctgcg

SEQ ID NO: 17925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttggcaatctttcccccaccatcgtgc

SEQ ID NO: 17926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttggcccacggggtccgttgcgttaac

SEQ ID NO: 17927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttggctgacgagggaataagacgtccg

SEQ ID NO: 17928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttgggggtcggcaattccaattgcacc

SEQ ID NO: 17929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggttgttgcggacacggcggcattggtat

SEQ ID NO: 17930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catggtttcgtgtttatgtactccttggttct

SEQ ID NO: 17931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtaaacgctggtgggacagatcctgaggg

SEQ ID NO: 17932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtaaccgattattaaagttggaatagctc

SEQ ID NO: 17933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtaaggcgggatgtgacaaattactgcca

SEQ ID NO: 17934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtacaatggatggttctcttacgggattg

SEQ ID NO: 17935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtacacagtaataccaattgccaatttgg

SEQ ID NO: 17936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtaccgcggcgagtgacgtaccattctct

SEQ ID NO: 17937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtacggacaaccccgtcgtgtgctcccta

SEQ ID NO: 17938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtacgtcgtaggtgtctgcgccacaaggg

SEQ ID NO: 17939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtactgcggtgtaacattcttcgtcaata

SEQ ID NO: 17940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtactgtcacctatcagaatactcgtgga

SEQ ID NO: 17941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtagataccccgcaactgttgccactctt

SEQ ID NO: 17942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtagattcgaacggttcgggtgaactacc

SEQ ID NO: 17943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtagcaacactagcgactagaccgcaacg

SEQ ID NO: 17944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtagctgaaagccattatcaacgcgggcg

SEQ ID NO: 17945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtataggtgaaaaagctatttttcggaaa

SEQ ID NO: 17946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtatcggagcttagtaggggccggcgggg

SEQ ID NO: 17947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtatgcgtacttggccaggcgagacgcag

SEQ ID NO: 17948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtatggatatagctctggtgttgcctgat

SEQ ID NO: 17949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtattcacaagcggaagcggggattacca

SEQ ID NO: 17950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtattcgttgtgatgacattcgtgaaaca

SEQ ID NO: 17951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcaccaggtgttgctctcccgtgtgagc

SEQ ID NO: 17952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcacggggtgaagacgcgtacgtggctc

SEQ ID NO: 17953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcactctgatcctctgtagttggcggct

SEQ ID NO: 17954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcatccggagccgagagttggcgtggaa

SEQ ID NO: 17955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcattgctgtgtagccagaaccatttcc

SEQ ID NO: 17956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcctcatatccagctggcgcagaacggc

SEQ ID NO: 17957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcctcgaaattgatctgtttgcgcgtga

SEQ ID NO: 17958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtccttctatctgattgtggccctaaccg

SEQ ID NO: 17959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcgaagagaagctacaaggccaagcacg

SEQ ID NO: 17960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcgcggattttcgtgcttgagaggcggc

SEQ ID NO: 17961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcgctggaaactgcccgttgccttcgga

SEQ ID NO: 17962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcggattgcttctgcccgcgttcttcat

SEQ ID NO: 17963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcggcctaattgcagcgatgctagcccg

SEQ ID NO: 17964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcggctctcaactgtggtcatggggaat

SEQ ID NO: 17965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcgtgagaatgtaagcacgactgtatcc

SEQ ID NO: 17966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtctacccttctattaacggcatcgcgat

SEQ ID NO: 17967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtctgctggcaggcttaaaacccctgttg

SEQ ID NO: 17968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcttctacactttttatcaacggctggt

SEQ ID NO: 17969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtcttgtgtgcagaggtttaagaaaaaga

SEQ ID NO: 17970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgaagaatccaagcgtattacttagggc

SEQ ID NO: 17971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgactgaggaggtcacagtgctactgag

SEQ ID NO: 17972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgcacagtctatacgagccggcgtcttt

SEQ ID NO: 17973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgcagcgcagtctcgtacagcagcgatc

SEQ ID NO: 17974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgccaaaatggtcgtgaccaaatgaata

SEQ ID NO: 17975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgccagcattcctcctaactggcccggc

SEQ ID NO: 17976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgcgcgcagtagttgcggaaccgtgtca

SEQ ID NO: 17977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgcgctgggacggaatgagtgttcgcct

SEQ ID NO: 17978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgcggatgctccctattttcaatgtacg

SEQ ID NO: 17979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgctcctccacgctccttaatgcactcg

SEQ ID NO: 17980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgctcctttacaccgaggggggtcattg

SEQ ID NO: 17981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgctctcagcggatccccgcatctgcct

SEQ ID NO: 17982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgctggacccgggtcaagacgggttacc

SEQ ID NO: 17983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtggcacatttagaccataacctttaagc

SEQ ID NO: 17984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtggcatcttgtaagtgtcgtttgggcgg

SEQ ID NO: 17985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtggcctccgactgctgcccagggctcca

SEQ ID NO: 17986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgggaaccggatcgcgatatgatcgtct

SEQ ID NO: 17987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgggactgatgatccccgccttctcctt

SEQ ID NO: 17988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgggcggtgtctccaggaggactggtcg

SEQ ID NO: 17989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtggggcccggggcgtgctcaggtgttgg

SEQ ID NO: 17990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtggggttcgggtttggttcgaactatta

SEQ ID NO: 17991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgggtacaactgcacctagccggttata

SEQ ID NO: 17992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgggttaacactggagtggctacttccg

SEQ ID NO: 17993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtaatacgttagatcgtttcgtacttt

SEQ ID NO: 17994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtaccgatgtgtccaaagtgatgggat

SEQ ID NO: 17995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtatccggccagtatattggttccgcg

SEQ ID NO: 17996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtcaggtgtccggtgttcaaagggtgg

SEQ ID NO: 17997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtcattggtctaaccgatttcctacgt

SEQ ID NO: 17998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtccctttaggaggacgggcggtgcaa

SEQ ID NO: 17999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtcgctctgcgggcgagttgatcatct

SEQ ID NO: 18000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtcgggccatgattttggttgcggatt

SEQ ID NO: 18001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtgcagttcctttcatttaattctaag

SEQ ID NO: 18002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtgcgatgcgatgtaggatctgtaaat

SEQ ID NO: 18003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgtgctaaccctgattacgctgctgacg

SEQ ID NO: 18004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgttaaatcaccccatcgcgtctctcgg

SEQ ID NO: 18005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgttaacctatacccgttcttttctgct

SEQ ID NO: 18006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtgttgatccttcccgggctttcgttgtg

SEQ ID NO: 18007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttaacagtttgcgtagtgctggaggaat

SEQ ID NO: 18008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttaagtatctcaggttgtatccgcttaa

SEQ ID NO: 18009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttacattccctagtagggtggtgcaagg

SEQ ID NO: 18010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttacggacttggacaccctttctgctga

SEQ ID NO: 18011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttagaaacatatgagtgcgcgggacgat

SEQ ID NO: 18012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttagctacggttgtttatcagtctggat

SEQ ID NO: 18013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttatgtgatcacctttagaagtaatgtc

SEQ ID NO: 18014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttattatgagctggagcttgacggcaat

SEQ ID NO: 18015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcagctcaatggtctgacgccggcgcg

SEQ ID NO: 18016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcatataatctctgcctttggatcgag

SEQ ID NO: 18017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcattttgctaggagaaacctttccct

SEQ ID NO: 18018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttccagttaggacggaagtgtttctgct

SEQ ID NO: 18019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcgataggctccccaacacgtcttttg

SEQ ID NO: 18020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcggtgcaacgatagcgtaaaggtctg

SEQ ID NO: 18021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttcgtaagcaagcacaggcgtctgtaaa

SEQ ID NO: 18022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttgagacgcactgttcaacgtcacttcg

SEQ ID NO: 18023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttgatcgttcggtccagctttgctctgt

SEQ ID NO: 18024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttgctcaacgaacagtcgtgcggcatcg

SEQ ID NO: 18025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttggttgacgagttggtgtcaaccgcgc

SEQ ID NO: 18026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttgttacctcagatgacggttagtggtg

SEQ ID NO: 18027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttgtttacctctcggtgtgcacgggcac

SEQ ID NO: 18028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtttcccgaacgtgaactctctacgcaca

SEQ ID NO: 18029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtttccgcatcggtacagttacctgagct

SEQ ID NO: 18030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtttgcgcactacgtatcaggccgtcggg

SEQ ID NO: 18031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgtttggacacttggatagcttctgcaagg

SEQ ID NO: 18032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catgttttgttttttgctactggcctcacgat

SEQ ID NO: 18033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaaaacaaggtcggagtcaggtcctgga

SEQ ID NO: 18034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaaccagcaaacttccgttatgatttat

SEQ ID NO: 18035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaacctggctgtatcttcttgttcctgt

SEQ ID NO: 18036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaagacccggaccttgagtggatggcct

SEQ ID NO: 18037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaacagtgtatcttatcacgcacttgact

SEQ ID NO: 18038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaacgttccgtgaggaattgcgatttggc

SEQ ID NO: 18039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaagaatgaacaagtccttttctctgagc

SEQ ID NO: 18040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaggtaagcacaacactgtcggactttt

SEQ ID NO: 18041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaaggttagtacgccccagtaaagttgtt

SEQ ID NO: 18042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaagtactttccttgcccgatcgagctgc

SEQ ID NO: 18043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaagtctttgggctggcgtgcacttttat

SEQ ID NO: 18044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaataccaaaaccaattcttcctttacgc

SEQ ID NO: 18045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaatacggttcgttttggcttcacagtcc

SEQ ID NO: 18046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaatccctttttaggccggcaactgacat

SEQ ID NO: 18047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaatcgagctgcggtaaggtgggggactg

SEQ ID NO: 18048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaatgacattacctgaatggggactgtcg

SEQ ID NO: 18049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaatggaggcagacaacagagatgcccca

SEQ ID NO: 18050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacaagttaagtgtctgtccgcctctaag

SEQ ID NO: 18051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacaatatcgcggattttatttgtggtac

SEQ ID NO: 18052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacacggacaaactccacccaagtgatgc

SEQ ID NO: 18053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacattacaacggcccaggttgacatttg

SEQ ID NO: 18054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaccactatgtgttacgggattgtctaga

SEQ ID NO: 18055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaccatgtgtgaaagtagcaagtcacacg

SEQ ID NO: 18056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaccccttgccaaggaggacggcttcgta

SEQ ID NO: 18057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaccgcgcatagctgtgtggttcgaacgg

SEQ ID NO: 18058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaccggatccctgacgtcgaatcatgcgg

SEQ ID NO: 18059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacctttaacgttgtcatcatgctaacat

SEQ ID NO: 18060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgaagaggtgggaagggggcacgtatg

SEQ ID NO: 18061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgaatacttagcagcattactatcgtt

SEQ ID NO: 18062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgagctggatagagcgttaatttgagt

SEQ ID NO: 18063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgatgcgattgtactaataactgactc

SEQ ID NO: 18064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgcatccaaagctcattagttcattaa

SEQ ID NO: 18065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgcgctgtgcaatgcagggcccggcgg

SEQ ID NO: 18066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacggatctatcatgcaaacgggttgagc

SEQ ID NO: 18067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgggctgccggcaaagcgttgtgtcgg

SEQ ID NO: 18068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgtgactgcatgctccgcgttgtggga

SEQ ID NO: 18069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattacgttcatgttcagtgtccacgagcgcc

SEQ ID NO: 18070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattactgatagtgtcgtgatggtaggttgat

SEQ ID NO: 18071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagatcctgcagaacctccttgcttgcgc

SEQ ID NO: 18072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagcagtccatgccaatttggtcgcgttt

SEQ ID NO: 18073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagcgctagatgagtgcagtgctgggggc

SEQ ID NO: 18074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagctgcaggccaaggttgaggttcttca

SEQ ID NO: 18075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaggaggcgttaccctctgttgtcgcctg

SEQ ID NO: 18076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaggatgcgtaatgggcgagcaacgtggt

SEQ ID NO: 18077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaggcaactcgtggaccaaatcgcacccg

SEQ ID NO: 18078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattaggttcacgttgtacaagcctgatctga

SEQ ID NO: 18079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagttatgttaatttcggccttcgttggc

SEQ ID NO: 18080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattagttcttagatttcgcaaaagtatggat

SEQ ID NO: 18081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatacgcgatgggcgcttcggtatgtacc

SEQ ID NO: 18082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatactcatgagtggccggataccatttg

SEQ ID NO: 18083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatagatcggttaccatgctgacgggggt

SEQ ID NO: 18084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatagctaggacgtccaataaaagagcgt

SEQ ID NO: 18085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcaaggggatgtatactcatgaggtgg

SEQ ID NO: 18086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatccatcgttctgtgtgtaccagatgtg

SEQ ID NO: 18087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcccagtcagttcgactaagaggtttt

SEQ ID NO: 18088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcgagaccgttgactttccccaagtgg

SEQ ID NO: 18089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcggcggaagctacgtcagggtgtacg

SEQ ID NO: 18090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcggtgcgcgatctgggttagtagctg

SEQ ID NO: 18091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatctaaagagtctcattcgtccattact

SEQ ID NO: 18092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatcttcgcacccgtactggtcttttcgc

SEQ ID NO: 18093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatgcatgatagtacaatgtccgtcgcta

SEQ ID NO: 18094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatgttgaaatgaactgctgcggctcgtc

SEQ ID NO: 18095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatgttgcttcccgacaagaccttagcgt

SEQ ID NO: 18096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatgttggttggtggacggcagctcgttt

SEQ ID NO: 18097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattattaaaatgttacgttttgggcaaggcg

SEQ ID NO: 18098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattattaaactcacgcttcgaggagacccgg

SEQ ID NO: 18099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattattactctaattcgtcctgttactcgat

SEQ ID NO: 18100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattatttcttccatctacactcaatggtaac

SEQ ID NO: 18101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcaagcgggaacactgggagtggtttggt

SEQ ID NO: 18102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcaatgtccgtagtcagaaggtttttact

SEQ ID NO: 18103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcacacatcacggattggttggcccgttt

SEQ ID NO: 18104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcacactattgtcttcgatgcgacgggtt

SEQ ID NO: 18105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcacatggaacggcggggggttggtgttg

SEQ ID NO: 18106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcacatgtgcctccgctgtatattggaca

SEQ ID NO: 18107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcacgctattatccctcccactcggcggg

SEQ ID NO: 18108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcactgaccaatcttagactagaccgtct

SEQ ID NO: 18109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcagcgttgacagtcggttgtgggcagac

SEQ ID NO: 18110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcagctcctggttctgccgtcgggtctaa

SEQ ID NO: 18111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcaggatgttaagttctggcggatgatcg

SEQ ID NO: 18112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcaggttgctgagctggctgttgctcctt

SEQ ID NO: 18113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcagtcttacatgcgcatgcctcctgcct

SEQ ID NO: 18114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcagttgaacattcgtagattgcgactct

SEQ ID NO: 18115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatcatggtcacacgtcggcatgtcaac

SEQ ID NO: 18116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatccttgttcaatgttagtagtgccat

SEQ ID NO: 18117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatgcaggcacaatggatattgccacat

SEQ ID NO: 18118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatggttctctgcaatcaccacgatacg

SEQ ID NO: 18119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatgtaggggagccctggtggtgcgaga

SEQ ID NO: 18120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcattcggagtgcgtgcacccgcgacttg

SEQ ID NO: 18121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcatttcctgtgcaaacatgcctggcctc

SEQ ID NO: 18122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccaacgctacctagctaaagtgtcgggt

SEQ ID NO: 18123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccacccatggtccgggacaggggtccga

SEQ ID NO: 18124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccacggtatcgtccgcgctagtcccgtg

SEQ ID NO: 18125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccactatccagtacagaggcgcagtaga

SEQ ID NO: 18126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccagactcacggtaattatcggctcttg

SEQ ID NO: 18127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccctcgatgcccctccattccgactcgc

SEQ ID NO: 18128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccctcgggttagtgggggtaacgcggtg

SEQ ID NO: 18129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccctctaaagctattcgtagactctcaa

SEQ ID NO: 18130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccgagtccaccgcatacacatatttaaa

SEQ ID NO: 18131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccgatccgcgtcggtacttcgtctagga

SEQ ID NO: 18132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccggagctcggtgggattatttctgggg

SEQ ID NO: 18133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccggatgtcgtgcttacgttcataggct

SEQ ID NO: 18134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccgggtcatcgggaagctattgttgcca

SEQ ID NO: 18135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccgggtgcagcttcggtgtgtgggccac

SEQ ID NO: 18136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccgggttctaggtcttccccggcagctg

SEQ ID NO: 18137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattccggttatagaaacagctgcttgtgttt

SEQ ID NO: 18138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcctcatcgttttgcaatcggctaccttg

SEQ ID NO: 18139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcctggcgacgagagggaccaccattcgg

SEQ ID NO: 18140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcctttagccctgcaaccgtaccttagtt

SEQ ID NO: 18141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgaagatgatggggtttattgattgcgg

SEQ ID NO: 18142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgacgtaaggcacgtacgcttagggggg

SEQ ID NO: 18143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgagcagctgcggtaactggtcttgacg

SEQ ID NO: 18144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgagctgcaagctgtggaggttgccagg

SEQ ID NO: 18145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgaggctactacccgttctgccaatgcg

SEQ ID NO: 18146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgatcatggacgagcagtcttacagggt

SEQ ID NO: 18147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgatcgtagcccttttctcccttcaatc

SEQ ID NO: 18148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgattggcaacggttcgtcattttaacg

SEQ ID NO: 18149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgcaacgtgtgctccgaggcaatcccga

SEQ ID NO: 18150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgcacgtccgccgtatagtagtgtgtag

SEQ ID NO: 18151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgcctttccgattaaggggcgtgggaac

SEQ ID NO: 18152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgcgataacgggatcaaaacatatcgtc

SEQ ID NO: 18153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgctgagagcaatgaagggtttgagagc

SEQ ID NO: 18154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgctgcaacaggcaaggggttcccatcg

SEQ ID NO: 18155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgctttgggccgttccactgggttcgcg

SEQ ID NO: 18156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcggcatatggaagcaagccggttgatta

SEQ ID NO: 18157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcggcatgagcttttcggtctgtgtgcat

SEQ ID NO: 18158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcggcggagtcatgcgttgttcaccgctt

SEQ ID NO: 18159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcggggctggagggtggggcagtgatatg

SEQ ID NO: 18160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgtcacatctgcagctctgacagtgatt

SEQ ID NO: 18161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcgtccctcgcgttcattatagattgttt

SEQ ID NO: 18162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctacaggcaacgtgatagcgcttagtgg

SEQ ID NO: 18163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctagacttggtttagctcacctgactcg

SEQ ID NO: 18164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctccagagcaagtccacgaagtagagta

SEQ ID NO: 18165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctcctcaaggtggtcattggggctctac

SEQ ID NO: 18166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctcctcgcgtggtgttccccgatggttg

SEQ ID NO: 18167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctcggaggatgcgtctaagaggatatct

SEQ ID NO: 18168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattctgtcatgggctcagcagtactacggaa

SEQ ID NO: 18169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcttatcgacaaacaggaacaattcctcc

SEQ ID NO: 18170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcttcctaccgctgaatctgcattctgtc

SEQ ID NO: 18171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattcttttactcacgagcgaaacgaactcgc

SEQ ID NO: 18172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaacaaacagtggggccagccgacaaca

SEQ ID NO: 18173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaaggtttagctgaaatttgtagggcgc

SEQ ID NO: 18174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaatggtgtaattcccactatacgattt

SEQ ID NO: 18175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgacctggctgggttgcgataactagcat

SEQ ID NO: 18176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgactgtctgcgcattatgggataacctc

SEQ ID NO: 18177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaggactccataatcatttcagcggtgt

SEQ ID NO: 18178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaggagtggcattatgcccgtacgacac

SEQ ID NO: 18179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaggggagcggtgaggagttcagtccac

SEQ ID NO: 18180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgaggtggcatgggcgctgggggtgcttg

SEQ ID NO: 18181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgagtatcccgccgaggtattggttggct

SEQ ID NO: 18182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgatcttcatccttgcggttgatgtcgat

SEQ ID NO: 18183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgatgaatctcacccgtcggcgtctgagt

SEQ ID NO: 18184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgatgcggtggaccagctggccgagcatg

SEQ ID NO: 18185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgatgttgaagagggggtggacggcgacg

SEQ ID NO: 18186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcaaggactacaaggtcaagtcccgcac

SEQ ID NO: 18187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcacagcccgttgatggtttaacgatac

SEQ ID NO: 18188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcacgcgacaaggcctcgtttgcacagg

SEQ ID NO: 18189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcagccaactgatagcgaagattgctgg

SEQ ID NO: 18190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcatgtcactataactagcggtagaaat

SEQ ID NO: 18191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcattctatcgttttttcggctaattat

SEQ ID NO: 18192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcattttagttaccatagtgctgatgac

SEQ ID NO: 18193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgccggttctcgactacgatacgtatgtg

SEQ ID NO: 18194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcgccgagctagcgcacctagttcgcga

SEQ ID NO: 18195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcggacaattgggatacgtaaagtccat

SEQ ID NO: 18196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcggctcacttctgctagttaacttggg

SEQ ID NO: 18197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcgggtagaagtatcggtaggacgccta

SEQ ID NO: 18198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgcgtatagatggttgttgtcgggctccg

SEQ ID NO: 18199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgctcaggtcgttgcgaaccaatgtttaa

SEQ ID NO: 18200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgctccagtccctggcacgacgtgagtta

SEQ ID NO: 18201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgctcgcggagggggtcaacgcaatctgt

SEQ ID NO: 18202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgctcgcttaaatggcattgaccgattca

SEQ ID NO: 18203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggaacttggttgggcccggagaatgtta

SEQ ID NO: 18204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggacacttagaggtgaaagtgtagcggg

SEQ ID NO: 18205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggacagggccgattcgatgccagatgcg

SEQ ID NO: 18206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggacattacgttgcgcgttgcatgcgga

SEQ ID NO: 18207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggaccgagcgggcatcagtatttgttgg

SEQ ID NO: 18208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggatacgctttgttcgtgttggacgggg

SEQ ID NO: 18209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggatatgcacgggtttcccctcattctg

SEQ ID NO: 18210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggattactcaggatttcagcaactgggt

SEQ ID NO: 18211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggcctcaaccccgagtccgctatcccgt

SEQ ID NO: 18212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggcctgtgatggtaaatgggcatggccg

SEQ ID NO: 18213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggctaacggagattgatgcgactgctga

SEQ ID NO: 18214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggctgtactggcttttggtacggttgat

SEQ ID NO: 18215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggcttcctgtaggcgacacgatcttatg

SEQ ID NO: 18216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgggcaggaagcatgaaatcgaactgagg

SEQ ID NO: 18217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgggccgccgtaatgccctacttgacttt

SEQ ID NO: 18218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgggctcggaacttttgtcggcaaacacg

SEQ ID NO: 18219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggtaaactaaagatggagggcgtgagtg

SEQ ID NO: 18220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggtacttgtgttttccgcataggttagc

SEQ ID NO: 18221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggtcatattaggtcgcggcgggagggct

SEQ ID NO: 18222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggtcgcttatgaggggattgaggcgcgg

SEQ ID NO: 18223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggttacagttcacaagtgtactagggtc

SEQ ID NO: 18224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattggttcttattccgatacagacaaacttg

SEQ ID NO: 18225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtaaaactgttactgtgcaacccttctc

SEQ ID NO: 18226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtaacctgggtattcccccttttggcgt

SEQ ID NO: 18227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtaagcaagggccgaaatagttcgcgca

SEQ ID NO: 18228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtacactggcactggttaactgcaaagg

SEQ ID NO: 18229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtagacagttagtagctctgtgcagaac

SEQ ID NO: 18230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtcatacacgttacccctagaccgggag

SEQ ID NO: 18231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtctgtatcctgtgtggccgtaacgagc

SEQ ID NO: 18232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtgaatatgagccctagcaattggcagg

SEQ ID NO: 18233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtgatgaatctctgacggtgcggttttc

SEQ ID NO: 18234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtgcgtggggaacagaagggttaacagg

SEQ ID NO: 18235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtggatacgggctcgaatgggcttcgcg

SEQ ID NO: 18236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtgggcgacttcctatcttccgcgacaa

SEQ ID NO: 18237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgttaagcggacgtttctgatggtaacat

SEQ ID NO: 18238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattgtttccgcgagctgggagtttgattggg

SEQ ID NO: 18239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttaacatcgcttcaagttcgtgatgctcg

SEQ ID NO: 18240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttaacggtcgactacccgaggatctgcgc

SEQ ID NO: 18241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttaagacagtcaacgcggcagcgctcgag

SEQ ID NO: 18242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttacaaagcttagaggcatacctgagcgt

SEQ ID NO: 18243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttaccaactcgaacagcctgcttgtgggg

SEQ ID NO: 18244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttacccctcatcattgtgtgcgcttactc

SEQ ID NO: 18245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttacgggtggccgcactgagcttcgcgaa

SEQ ID NO: 18246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttactgtcccggtcagtatggaatgtttc

SEQ ID NO: 18247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttaggagtggtgattgcgtggtgtgattg

SEQ ID NO: 18248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttagtgcaatattgtattcaggtatgcca

SEQ ID NO: 18249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttatgctgcgaggtaacgcggtactttta

SEQ ID NO: 18250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttatgtcgcgcctttttgggatcagtgcg

SEQ ID NO: 18251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcacgtacaactccgcatcctcgaaccg

SEQ ID NO: 18252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcagtgaacggggttcggttattcctcg

SEQ ID NO: 18253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcataacaccatatggttcaattatatc

SEQ ID NO: 18254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcatcgtcatccgagagcttcaggtttc

SEQ ID NO: 18255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttccggcgggtggtgcgggtacgttgcgt

SEQ ID NO: 18256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcctccaagagattcaggcagcgtttgt

SEQ ID NO: 18257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcgaaagaagggtttgttgtccgatgtc

SEQ ID NO: 18258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcgacctggttgcgggatactcctgtgt

SEQ ID NO: 18259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcgagcgtattttttatgaggacgtgac

SEQ ID NO: 18260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcggatccaggagtctgaagccgcgatt

SEQ ID NO: 18261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcgtggcagcacactaccgcgggttccg

SEQ ID NO: 18262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctaactcttccgtgtttcgcttgctcc

SEQ ID NO: 18263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctcgaaacttgttgttgcagggcgagc

SEQ ID NO: 18264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctcggatgaacctaacacaacccctta

SEQ ID NO: 18265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctgatccgcgaagtaggttttctttcg

SEQ ID NO: 18266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctggtgccgtggcgtctgacatgatgt

SEQ ID NO: 18267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttctgtctggtcctttgcacccgtataat

SEQ ID NO: 18268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcttaccgacacgtttcaggatggtcga

SEQ ID NO: 18269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttcttctacgagcgtctgatctattggtg

SEQ ID NO: 18270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgacggacattactggatgactacctta

SEQ ID NO: 18271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgacggtcaaactgcgcgtttccccttc

SEQ ID NO: 18272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgagggcgaatacccgggtcgcatcgtt

SEQ ID NO: 18273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgagggggtgcggtgccgcggcttgtgc

SEQ ID NO: 18274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgatggacagtctagcgctaattacgag

SEQ ID NO: 18275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgcaacgcactgggtaagtctacgccac

SEQ ID NO: 18276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgcatcagactggagggccctgcaaggg

SEQ ID NO: 18277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgctggcgaaccttcaccacattttccg

SEQ ID NO: 18278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggccgcgacgagggaattttgctgacg

SEQ ID NO: 18279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggctgagcagaaggtacttgtgtccgg

SEQ ID NO: 18280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggctgccacggctgaaatcgctacgat

SEQ ID NO: 18281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgggattgagtgactcatattttgggct

SEQ ID NO: 18282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggtcatacctccagtggtttctccacg

SEQ ID NO: 18283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggtgttccgtataaacgactacggcga

SEQ ID NO: 18284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttggttgcgttacgcaaggggtttttgtg

SEQ ID NO: 18285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgtattgactagattcagtccgtgacgg

SEQ ID NO: 18286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgtgcgcagtgcttaagtggcgcggaac

SEQ ID NO: 18287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgtgtgtggccagctccttttatcgcga

SEQ ID NO: 18288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttgtttgatgggcaatagaccactgacgt

SEQ ID NO: 18289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttagagacatctgcgaactccctcggcc

SEQ ID NO: 18290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttaggccagtcggttctcgctgttggct

SEQ ID NO: 18291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttagtaaggttttccttacttctctcgc

SEQ ID NO: 18292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttatgtccagagcattcactcatcggtc

SEQ ID NO: 18293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttccggattggtctaggatcacaactga

SEQ ID NO: 18294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttctaaacagcattccttcatacctatc

SEQ ID NO: 18295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttctatctcttaccgatcaaaggcactt

SEQ ID NO: 18296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttgatgtgaggagtcacgaagccacggt

SEQ ID NO: 18297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttgggcggtataaacttcatggggcggg

SEQ ID NO: 18298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttggtgtgtacattacgtttttgacgaa

SEQ ID NO: 18299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttggttgaaccgcacctagcacgggggt

SEQ ID NO: 18300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cattttgttgttcggtcaggctgtgttctagg

SEQ ID NO: 18301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttttcatgaagtgtgaccgcgtgcattac

SEQ ID NO: 18302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
catttttttactgatcaacaacattctcgtat

SEQ ID NO: 18303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaaatacctgtcacgctgacgtcgctgtt

SEQ ID NO: 18304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaaatcggtctagcccggaacatatgcgg

SEQ ID NO: 18305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaacagtctgtcctttcgctaaggattac

SEQ ID NO: 18306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaaccagagttagcatgcagggagggcct

SEQ ID NO: 18307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaacgagtcacagtatccgtagtttacgc

SEQ ID NO: 18308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaacgtaatgtaggcgatctttcctaggt

SEQ ID NO: 18309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaacgtggcgggtaccggggttgtgtggc

SEQ ID NO: 18310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaactaggcgtcggctacgactgatctga

SEQ ID NO: 18311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaagactggcagtgctcgtcagcgtttgg

SEQ ID NO: 18312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaagggctaacaggttcgcgcaccggggt

SEQ ID NO: 18313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaagtatcatcacgtaaacgaacgaaatg

SEQ ID NO: 18314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaatggacggtttgtacctttcgtcgttt

SEQ ID NO: 18315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaatgggaggtttagccttaatgtagggt

SEQ ID NO: 18316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaatttttcttctcggcgttttcatgcaa

SEQ ID NO: 18317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacaacagaagatcgcctggcacgcagga

SEQ ID NO: 18318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacaagcggtaggacgtgaagacgcggcc

SEQ ID NO: 18319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacaggggagtagaccacgtctcacggtg

SEQ ID NO: 18320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacatatcggcctgcttagctgattcgtt

SEQ ID NO: 18321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacatgccaccaacccacctatggtaccc

SEQ ID NO: 18322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaccacggttcgaagcggagaaagatcgg

SEQ ID NO: 18323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaccagggagccaaatcatcatccacgcg

SEQ ID NO: 18324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaccctatgaaggtcactaggggccactc

SEQ ID NO: 18325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaccgattatccatggttataggacgtgc

SEQ ID NO: 18326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacctaattggtgggctacgagcgactgc

SEQ ID NO: 18327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacgatccaaatgcggttacatgtcggcg

SEQ ID NO: 18328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacgcacagtagaggcttggttcgcgacc

SEQ ID NO: 18329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacgcacattcgcccgcttttactacttc

SEQ ID NO: 18330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacggcttcggcgatgtgaggcgagttgc

SEQ ID NO: 18331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacgtgaatgatgacttggacacggtcac

SEQ ID NO: 18332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaactcacgcacccgcactgcaatgatttc

SEQ ID NO: 18333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaactccagagcgctgggctgcatcgtggg

SEQ ID NO: 18334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaactctcattgccggttccacacgtattc

SEQ ID NO: 18335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaactgagtgcggaaggtctgatctggccc

SEQ ID NO: 18336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaacttaggctccgtcttggtctacacaat

SEQ ID NO: 18337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagaacgtggttagcgggacggcccctgt

SEQ ID NO: 18338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagactgcacgcgagctaaactcttcggg

SEQ ID NO: 18339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagatgctgagggttaaggtttgccaaga

SEQ ID NO: 18340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcacagtccatttggtcaaggaagcgc

SEQ ID NO: 18341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcattagtatatccttccaacctctgt

SEQ ID NO: 18342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcctcggttcggagaattgacgagcgc

SEQ ID NO: 18343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcgaatgggtgaaactctagctgtgag

SEQ ID NO: 18344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcgcatgctgattgtaccgagccgatc

SEQ ID NO: 18345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcgcgtcttctacgaccggtgtttggg

SEQ ID NO: 18346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagcggcgaattttcggctggtccgcctt

SEQ ID NO: 18347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggacactggccgggtcggtgggttact

SEQ ID NO: 18348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggatatgctccctagcgtgctaaagtt

SEQ ID NO: 18349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggcattaacctgctatcatgcgttggg

SEQ ID NO: 18350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggctagtggagttactggaccggccct

SEQ ID NO: 18351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggctgatgaccgataccaacatatcgc

SEQ ID NO: 18352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagggaagtgcatcagccttgatttgttg

SEQ ID NO: 18353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagggctagggacattaagaccatggtgc

SEQ ID NO: 18354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaaggggctagtatccgtacatgattagtc

SEQ ID NO: 18355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagtattgcgaagtagcagaagatgcaac

SEQ ID NO: 18356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagtctggagatatagtccgtgtaatagg

SEQ ID NO: 18357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaagtgaagcggcataggagggtgtaagtg

SEQ ID NO: 18358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaataatggcgagactatagactagtgcga

SEQ ID NO: 18359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaataggtaagtacaatggtatttgctacc

SEQ ID NO: 18360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatatcttttctgcggggactaaggcgtg

SEQ ID NO: 18361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatcagtagtacattaatcaaccgtcgaa

SEQ ID NO: 18362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatcgagcgaagagaacctagcgcggtgg

SEQ ID NO: 18363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatgaattgccttgcggacgtacgcgtcg

SEQ ID NO: 18364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatgcacgagtgggctcctgcggatcctg

SEQ ID NO: 18365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatgccgtttcgtatttacgtaatggaag

SEQ ID NO: 18366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatggatttcgtcagcctcgtgtgcatga

SEQ ID NO: 18367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatgggggtgatcatgacgacagtttgac

SEQ ID NO: 18368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatggttactgctcagctcacttcagccc

SEQ ID NO: 18369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatgttaaatactggtggttagatgtctt

SEQ ID NO: 18370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaattcacccgacgttgcggttgagccttg

SEQ ID NO: 18371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaattgtactcggtcgcggccgggtcgcgg

SEQ ID NO: 18372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaatttcgagtcgtcagagattgtgcggcg

SEQ ID NO: 18373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacaacccttggttctgtgcacctggcgcg

SEQ ID NO: 18374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacaaggcgaaagccacaagctggtgactc

SEQ ID NO: 18375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacacaagtttttgactcgcagtatcaact

SEQ ID NO: 18376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacacgtcaccgcccggttgatcttagtca

SEQ ID NO: 18377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacacgtgacgcgaacattgtgtcgggggc

SEQ ID NO: 18378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacactagttacgaggtacggtctgcacaa

SEQ ID NO: 18379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacactccatgcgcgcgcttaacccaggcg

SEQ ID NO: 18380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacacttttgtttacctaacacagtacgaa

SEQ ID NO: 18381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacagaggttgtacacaattcgtattcggc

SEQ ID NO: 18382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacagatatgtacatgggcgctcgtcaccc

SEQ ID NO: 18383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacagcgctccaagcttacatcgccttctc

SEQ ID NO: 18384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacaggcccctggttcgtgactctgaccgc

SEQ ID NO: 18385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacagtttctctttgttgcagacattatgg

SEQ ID NO: 18386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacatcggcaaagcgcaagtggttcaaggc

SEQ ID NO: 18387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacatgcgtggtaaccagtctcagaactct

SEQ ID NO: 18388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacatgttcatatgttcaccttgggataac

SEQ ID NO: 18389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacattaggccttgctatggtgggcaaggt

SEQ ID NO: 18390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacattagggctgtcatgctaatttgcgcg

SEQ ID NO: 18391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccacgctgcagattatggtcggatgggt

SEQ ID NO: 18392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccagggcgctccgttgcgtttcagcggg

SEQ ID NO: 18393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacccaacgaaagaggtgtacgcatacgga

SEQ ID NO: 18394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacccattcccggaaggttccgaggtagcc

SEQ ID NO: 18395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccccactgggctctgggatcaaccgtct

SEQ ID NO: 18396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccccagtgttacacttaattggtaattg

SEQ ID NO: 18397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccccggtcctttttgttctcagcggtta

SEQ ID NO: 18398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccccgttcgatgatttgtacattcgatc

SEQ ID NO: 18399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacccctaagcgcgttcaggccgatagggt

SEQ ID NO: 18400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacccgctacaagccgtgggcgttatgcct

SEQ ID NO: 18401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacccttcatctagttcgtattctttatca

SEQ ID NO: 18402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccgaccgtgaatatgcaatatcgctcgc

SEQ ID NO: 18403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccggcgcagtctaacaattgcgcctgca

SEQ ID NO: 18404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccggtcgcattacacgaacgcgtatacg

SEQ ID NO: 18405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccgttgggatagtgctctgcgcgtgtag

SEQ ID NO: 18406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctaactgtatgtgcaaacatctccatc

SEQ ID NO: 18407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctagcctccatgcatttggctgttttg

SEQ ID NO: 18408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctcgggactagatgtggggaaccgtga

SEQ ID NO: 18409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctctcctgtaagctggtgtgatgttgc

SEQ ID NO: 18410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaccttcacgctcagctgcccgtcaagcgc

SEQ ID NO: 18411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctttttcttcatcctcgtgcctttcga

SEQ ID NO: 18412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacctttttgcttgggaccgtattgccgtc

SEQ ID NO: 18413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgaagcagtctaaacaccgctggcatgt

SEQ ID NO: 18414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgactacacgaatgtaatcacttttagg

SEQ ID NO: 18415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgagcaggcctgtaactttgaatctttt

SEQ ID NO: 18416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgagtaggcgctggttggttatcaacgg

SEQ ID NO: 18417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgatcagaagtgggtgtgtgaatcatga

SEQ ID NO: 18418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgatcgtcgtcaaaacgcacattcggca

SEQ ID NO: 18419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcagtgaactacaccacagcagccatg

SEQ ID NO: 18420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcatacacctgcggaggcgctctgccg

SEQ ID NO: 18421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcctgctattatttttaccggggtgga

SEQ ID NO: 18422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcgaacagtgtgaatggagccatacgg

SEQ ID NO: 18423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcgcggtgtggtagccggcctatattg

SEQ ID NO: 18424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcggcttatcaaagcggccgactctag

SEQ ID NO: 18425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcgggggctctctgctcggctggatca

SEQ ID NO: 18426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgcgtcgatctgtttgttttaagattgg

SEQ ID NO: 18427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgctccggggctttgtttctgtactcgt

SEQ ID NO: 18428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggaaacgggtcattaattttcctatgg

SEQ ID NO: 18429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggacggatttacgaaatagggtcacca

SEQ ID NO: 18430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggagtcatcgatttgggtcgccttgga

SEQ ID NO: 18431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggatccggcctgtcttttcactggccc

SEQ ID NO: 18432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggcacaccgaatgtagtagtcgcgcgg

SEQ ID NO: 18433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggcttctcaggcgtgacacctacgcgt

SEQ ID NO: 18434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgggagggacttttacttctccgtgggt

SEQ ID NO: 18435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgggggttttgcagtccttcgcttagtc

SEQ ID NO: 18436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggggttccgctcgtcagtttgtcggtg

SEQ ID NO: 18437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgggtaaggtatgggggtagggccaccc

SEQ ID NO: 18438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgggtcaattgcagcgggtgggcgctac

SEQ ID NO: 18439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggtgggtttacattggcaattagggcg

SEQ ID NO: 18440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggtgggtttgggtgactaactagtcgc

SEQ ID NO: 18441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggttaacatagcgcacgtccttgtgct

SEQ ID NO: 18442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacggttcgcgtgtagtcaggcttaatctt

SEQ ID NO: 18443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgtagccagcagttccacgtcaggggcg

SEQ ID NO: 18444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgtccggaccaaagggctcagtggacgg

SEQ ID NO: 18445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgtcttgtatcgttctcgtcgcccggag

SEQ ID NO: 18446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgtgatcgagacaggcctcgtttggtgg

SEQ ID NO: 18447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgttatgcattcgtggtaccgtacgttc

SEQ ID NO: 18448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacgttgtcagctggttaagcacgacttta

SEQ ID NO: 18449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactaattcaccgataaatcaagctcctgt

SEQ ID NO: 18450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactacgcgattagccacaacaggcacggg

SEQ ID NO: 18451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactactaaacggacactgcacgaatttgc

SEQ ID NO: 18452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactccatcgcactatcccactcggaggtt

SEQ ID NO: 18453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactcgataatgtgatgccgccggaactgg

SEQ ID NO: 18454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactcgatactcgctatagaagtctcatta

SEQ ID NO: 18455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactcgattcgacaccatgttcggacgtat

SEQ ID NO: 18456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactctccgcggcccccggtgtgagcccgt

SEQ ID NO: 18457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactctgcgaaactgtgaggtgcccagact

SEQ ID NO: 18458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactgacacccaacctaacgcgatctgttt

SEQ ID NO: 18459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactgaggcggtggtcccttgccggttatg

SEQ ID NO: 18460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaactggtgcaatgaattcaggtgcctctcg

SEQ ID NO: 18461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacttgcaaattcgaggtgacgctatgctg

SEQ ID NO: 18462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacttgccggccaagaattgagttttgagg

SEQ ID NO: 18463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaacttttggacacaacgcaggggtagaagt

SEQ ID NO: 18464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagaaaccacatgttgttagcgccaacagg

SEQ ID NO: 18465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagaacccggcattaactgaggtaaggggg

SEQ ID NO: 18466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagaagagtatgctggttaacggatcggga

SEQ ID NO: 18467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagacatgagaggtaaatcttgatccagtt

SEQ ID NO: 18468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagaccgggcggcagtatgctcacgcttac

SEQ ID NO: 18469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagacgtatgccgtgactaattgtcgtact

SEQ ID NO: 18470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagactgggctgttgggtgaatgccgcttg

SEQ ID NO: 18471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagagcgaaagataatgcgacgaggagaga

SEQ ID NO: 18472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagaggggagaacaaaagaggacatcaggg

SEQ ID NO: 18473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagagtcggacctgaagcctcagttactac

SEQ ID NO: 18474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagagtgatagtcgctccagtagttcggtg

SEQ ID NO: 18475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatacagacatcagtaagcttagcgttg

SEQ ID NO: 18476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatatgaaaggcggcgactttccaatcg

SEQ ID NO: 18477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatcactccgtcggcgcacagtatcggg

SEQ ID NO: 18478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatcaggcgtacggtttcttccacagcc

SEQ ID NO: 18479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatcgctatcgtggttgtggcaataacg

SEQ ID NO: 18480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatgatggttattggatgctgcggatct

SEQ ID NO: 18481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatggacattcatcgtcttcggataacc

SEQ ID NO: 18482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagatgggagcatttggaccactcctgttg

SEQ ID NO: 18483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagattatgggcgtcggaccccgtgcgcgt

SEQ ID NO: 18484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagattcccggtactacgttctcacggctg

SEQ ID NO: 18485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcaccaaataagccctgggtgttgaccg

SEQ ID NO: 18486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcagaactttggaggcttattgcacggc

SEQ ID NO: 18487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcagaggcatccggtgggatcgggcgtg

SEQ ID NO: 18488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcagcacgagatgtggactttaggacgt

SEQ ID NO: 18489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcagggctgtcacctcctatgtcatagg

SEQ ID NO: 18490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcccaaatcaccgacaggaggctcctgg

SEQ ID NO: 18491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcccatacctaaacggctcgttctcggg

SEQ ID NO: 18492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcgacccgatgtataactctcgcgcgtt

SEQ ID NO: 18493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcgcacaactaaacaaaggtaagcaacg

SEQ ID NO: 18494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcgcagtatagcaaaggaggtctgcccc

SEQ ID NO: 18495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcgcgaggttttcatggccgagcagacc

SEQ ID NO: 18496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcggactttcgcggctgctggtactccc

SEQ ID NO: 18497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcggccaagtagatctttgcgctactca

SEQ ID NO: 18498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcgtccgaggcctaagagtaaataagcg

SEQ ID NO: 18499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagctcccgcaccataacgaatcatacggg

SEQ ID NO: 18500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagctgggctagcatgggatcgaactgtta

SEQ ID NO: 18501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagcttgccgcccaacgcattgagtgcagg

SEQ ID NO: 18502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggaaccagttacgcccccttatgtcatc

SEQ ID NO: 18503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggacataggaggttgcagactgtcccat

SEQ ID NO: 18504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggacatcagataaaggcgatgtcgttcg

SEQ ID NO: 18505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggagatgtgcattcgtaaacatgtaccc

SEQ ID NO: 18506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggaggaggccacactgcagtccaccgtc

SEQ ID NO: 18507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggaggataattttcgtcgttgcgggata

SEQ ID NO: 18508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggatcttgcttccgtggaagtgctttgt

SEQ ID NO: 18509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggcaagatcttagttgcgatgcatgagc

SEQ ID NO: 18510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggccaagaagggctgaactaacgcgtct

SEQ ID NO: 18511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggccatgaaaacagtgtggcaactcctc

SEQ ID NO: 18512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggccgaaccaagataggacggtcagtga

SEQ ID NO: 18513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggcggaagggcagcttagccgcaggcgg

SEQ ID NO: 18514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggcggactgcgtgagtggcgcgagtggg

SEQ ID NO: 18515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggcggggactgattatttagcattttct

SEQ ID NO: 18516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggcgttcgtactcgacgcataccgtggg

SEQ ID NO: 18517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggacagggcgctcatcgcggaaggtag

SEQ ID NO: 18518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggacttacgtaatatcgcgttgattca

SEQ ID NO: 18519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggcgaagggggatcagttagcgtccac

SEQ ID NO: 18520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggcgtccgtaattctagtgacctaatg

SEQ ID NO: 18521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggggggcgggttcgaggagctatatggg

SEQ ID NO: 18522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggtacgtatcgtgttttgtgtgccgct

SEQ ID NO: 18523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagggtgcagatgaaattgcggtactcagc

SEQ ID NO: 18524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtaaacgatttagtccagcccaaggca

SEQ ID NO: 18525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtagacggaggcaatgttgtgaccccg

SEQ ID NO: 18526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtagttgcgcgtcccatgtctgttgtc

SEQ ID NO: 18527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtcacatttgtttttccaggtatgctg

SEQ ID NO: 18528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtgaaggaggatcggcattcttggttc

SEQ ID NO: 18529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtgctaagtaagctcaactcctgactg

SEQ ID NO: 18530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtgctctgtatacggtaattcatgggt

SEQ ID NO: 18531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtggaccaattcgggtatgggtgggct

SEQ ID NO: 18532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggtgtcttcaggtagttttctcggatgg

SEQ ID NO: 18533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggttcgaggagccggtgtaggaggcccg

SEQ ID NO: 18534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggttgaaagggagtaggaggcgctctcc

SEQ ID NO: 18535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaaggttgccatcgagggcctacagctcgca

SEQ ID NO: 18536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtaatgcgatggcggagaatctgtgtgg

SEQ ID NO: 18537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtacctgtctcggaaggattttgtagtc

SEQ ID NO: 18538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtagtcatcccggctctacgcgtcacga

SEQ ID NO: 18539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtatggggacatgggatatcaggacacg

SEQ ID NO: 18540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtattatgccgtgggtagcgttagggcc

SEQ ID NO: 18541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtcactcgggaaaaagtttagttcgagc

SEQ ID NO: 18542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtcagctccgatgtgaaactgcctgctg

SEQ ID NO: 18543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtccgttcttccacctcgttgtttcgtt

SEQ ID NO: 18544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtcgtgatttgatcgtgctgtgccaacg

SEQ ID NO: 18545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtcttctataaacatgtagcttaaagta

SEQ ID NO: 18546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtcttttgccccgacgaaaaacgtatct

SEQ ID NO: 18547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgagctgggccattgcctgtgtcgtgt

SEQ ID NO: 18548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgaggcaggtacccgcgtcaagattgt

SEQ ID NO: 18549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgcgtatgacatcgacttctgtttaac

SEQ ID NO: 18550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgggcccggagttcgctgtgaatgctg

SEQ ID NO: 18551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgtaggggcaacaatacggctcgtcgc

SEQ ID NO: 18552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtgtgttaacggtccataatgcggctat

SEQ ID NO: 18553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagttcaccgtcctgctgttgaatcctcta

SEQ ID NO: 18554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagttgacagcttgtcccgctatgtcgacg

SEQ ID NO: 18555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagttgggatgggtttggctattgtccgct

SEQ ID NO: 18556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagttggtttttctaggcgacgtgccagtc

SEQ ID NO: 18557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtttcggttttgatcgcaggcgctcttt

SEQ ID NO: 18558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaagtttgtttttctaatagacgggtttggg

SEQ ID NO: 18559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaataacagaagtgccccggagtaaatctgg

SEQ ID NO: 18560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaataactcgcgactcatgcggtcggctagc

SEQ ID NO: 18561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaataatcagggggttgaggcaggactctat

SEQ ID NO: 18562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatacaaggcgaaacgtaagcggacattgg

SEQ ID NO: 18563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaataccaatttggggcgttgttaatgggat

SEQ ID NO: 18564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatacgcggaaccgccacgcagcgtttgaa

SEQ ID NO: 18565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatacggcgggcgatgggtcggatagcatg

SEQ ID NO: 18566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatacggggagcgtgaagtggctcgggtcg

SEQ ID NO: 18567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatactgattacgttcactgtgaaatgcgc

SEQ ID NO: 18568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatactgggggtacgtggtcgggttgggcg

SEQ ID NO: 18569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagagtccgcgacgaccgtttggcactg

SEQ ID NO: 18570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagcgcgcacgtgtaatttctgattagg

SEQ ID NO: 18571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagggcgaatcgcacgggatcacgacat

SEQ ID NO: 18572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagtctcggggaatagaccaggagcctt

SEQ ID NO: 18573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagtggacgagaacaagtactctcatgc

SEQ ID NO: 18574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatagttgacactgcgctggaagctctcga

SEQ ID NO: 18575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatacagactgactcagctgtttcttca

SEQ ID NO: 18576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatagcgcactgaggcgtaggtgtgggc

SEQ ID NO: 18577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatattgtaccaaattctagagatttgt

SEQ ID NO: 18578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatccctttatgacggtgccctctgctt

SEQ ID NO: 18579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatggctacgagctcagggttcacgggg

SEQ ID NO: 18580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatatgtgaatgcttcatgcaactgtgtat

SEQ ID NO: 18581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcaagtggagttctatgtgccagagttt

SEQ ID NO: 18582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcacgatcgcgggagggtcgctactggc

SEQ ID NO: 18583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcactaaacccgtcgatccttagagtgc

SEQ ID NO: 18584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcagacatgtctgtcctggggacacctc

SEQ ID NO: 18585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcagagggaatggcgccattccccgttc

SEQ ID NO: 18586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcagcaagaaagccctgcaggctcggac

SEQ ID NO: 18587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcatgtgcgtggacaagctgctatgttt

SEQ ID NO: 18588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcattttggctattgtagtgtgcgcgtg

SEQ ID NO: 18589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatccaagctgaagcaagtgcacgtggtgc

SEQ ID NO: 18590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatccaagtttaaaatagttcattgtatgg

SEQ ID NO: 18591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatccattcaggcgggttcgcccaactctg

SEQ ID NO: 18592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcccgtaggtgtctttcggcctggtgct

SEQ ID NO: 18593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatccctcatcatgcgtgcagttgttcaat

SEQ ID NO: 18594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatccctgtagggtaagtcgctccatacac

SEQ ID NO: 18595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcctcctcgcataactgtctgatccccc

SEQ ID NO: 18596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcggcatttggggtcaggtttagatggc

SEQ ID NO: 18597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatcggcgtactaatgcgtgatctggttac

SEQ ID NO: 18598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatctcgggtcttcagcgtgtccacaacca

SEQ ID NO: 18599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatctgcgaactcgcacgcccctgatccta

SEQ ID NO: 18600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatctggagctgcggggacatggcagttgt

SEQ ID NO: 18601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatctgggcgactgtggacgtctctgtagg

SEQ ID NO: 18602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgacagttgcaccattacctgtcctgtg

SEQ ID NO: 18603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgacccttcaggtatactgcgaggaggg

SEQ ID NO: 18604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgatagtcaggttcttggacgcctcata

SEQ ID NO: 18605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgcatcagagtggtaccagtcatgacgg

SEQ ID NO: 18606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgctcagccttcgtcatctgcaggatgc

SEQ ID NO: 18607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgcttctcgagtctttagtactttccgc

SEQ ID NO: 18608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatggagatgatcgccaaaggtgcgcctgg

SEQ ID NO: 18609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatggcgtcactttaatttgtcggtcgtcg

SEQ ID NO: 18610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatggcttagccgaggggactgtgtacgcg

SEQ ID NO: 18611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatggtcacaggcatgctgtggtccacgta

SEQ ID NO: 18612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatggtggtgctggatgctcgcggtttata

SEQ ID NO: 18613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtacatatatgtccgccgttgaaaaac

SEQ ID NO: 18614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtcctcttatctgtcaacatacacctt

SEQ ID NO: 18615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtcggggggtgtttaacgtacggtcct

SEQ ID NO: 18616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtctaaactaggattagggtccggcgg

SEQ ID NO: 18617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtgccttttcgtttggccgccttggtt

SEQ ID NO: 18618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtgcggcagctgtgcttatcttcacct

SEQ ID NO: 18619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtgcgttgattgcttcggtttgagccg

SEQ ID NO: 18620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtggacctggcaatggggctgaacatg

SEQ ID NO: 18621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtggcagtgagtctggagcagttgggg

SEQ ID NO: 18622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtgtggcctttcggtcgaaatgtccgc

SEQ ID NO: 18623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgttccttgcataatttggttgtatacc

SEQ ID NO: 18624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgttgtgtctgttgtttggtcctttctt

SEQ ID NO: 18625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtttccggttagtacagctcgacggtg

SEQ ID NO: 18626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatgtttgggttgtggactgtcttgcgttc

SEQ ID NO: 18627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattacatgaatgacaaccgtcttcccccg

SEQ ID NO: 18628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattcaaggagcccacgtgtctgtcatttt

SEQ ID NO: 18629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattcccaataccctctccttctcaactcc

SEQ ID NO: 18630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattccgtcgccgctggaatcgcacagaat

SEQ ID NO: 18631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattcggggcatcggaaaaaggatgggttg

SEQ ID NO: 18632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattgatgggtaaaagacgacttacgcgcg

SEQ ID NO: 18633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattgccttttcgaaccgtatggtgcaacc

SEQ ID NO: 18634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattgctagcgaagaagtgctggggtttcg

SEQ ID NO: 18635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattggacgcagccaacgtggtatagtgcg

SEQ ID NO: 18636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattgtcttcccaaatcgcgatccgttcca

SEQ ID NO: 18637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattgtgtgttattgaggtgccccaagatg

SEQ ID NO: 18638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatttccctctggccgtagattgcagagag

SEQ ID NO: 18639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaattttggttggcttggccacaaggtgcgt

SEQ ID NO: 18640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaatttttggctcacgtaatgctctaggtca

SEQ ID NO: 18641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaaatctagaagtatcatgagtcttggt

SEQ ID NO: 18642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaaatgggccgcgctgtagacttaatcc

SEQ ID NO: 18643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaacaggtctcaagttggaaggccatcg

SEQ ID NO: 18644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaactggcgaggtggcgattgataatcc

SEQ ID NO: 18645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaagagtacgctttactccaggcttggc

SEQ ID NO: 18646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaagggactgcattgatagtttgtgtcc

SEQ ID NO: 18647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaagtctgggcaatgtcggaagctacta

SEQ ID NO: 18648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaaatactcttcgacccggaaagtttgtc

SEQ ID NO: 18649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaacgtagtggctggtatacggtcgtagg

SEQ ID NO: 18650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaactgcctggtttagagcagctttaagg

SEQ ID NO: 18651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaacttttagacgagcccgatgcaccaag

SEQ ID NO: 18652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagactgggttttcgacttaagtcactg

SEQ ID NO: 18653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagatccgcagttgcagccctgctatgc

SEQ ID NO: 18654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagccggaccggggtcttacttgtttca

SEQ ID NO: 18655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagcttgagcatgcacgcccgcatcgca

SEQ ID NO: 18656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagggagatgctcaggctcattgttagc

SEQ ID NO: 18657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagggttactcgttatttcgattcggca

SEQ ID NO: 18658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaagtcaaggggcggcccacggtaactgt

SEQ ID NO: 18659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaatactagattcattatggtagcaggtt

SEQ ID NO: 18660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaattaggttgttagaagacaacatttac

SEQ ID NO: 18661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacaaagtctgtcttagggctgttcaagc

SEQ ID NO: 18662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacaagagttaacgctgctccgatttgca

SEQ ID NO: 18663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacacctgacgaagtatcatgcatgccgg

SEQ ID NO: 18664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacacgttatactcgcggatccatcactg

SEQ ID NO: 18665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacagccgatcgtgactgaggggccagac

SEQ ID NO: 18666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacagcgatatgcatcaagaggaagcgac

SEQ ID NO: 18667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacagctctgtactcctcacacttcgcgc

SEQ ID NO: 18668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccaaaggaacaagacccaggtcttgag

SEQ ID NO: 18669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccaacatgcagtgctatgccacgcagg

SEQ ID NO: 18670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccacccagcgggagatagtgccagagg

SEQ ID NO: 18671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccagtcctattcttgctagtcaggaga

SEQ ID NO: 18672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacccccggcagcgaatactactcaggga

SEQ ID NO: 18673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacccggttcaacttgtttactgaggttc

SEQ ID NO: 18674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccgctgagagtcgacccatcgcttctc

SEQ ID NO: 18675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccgtttcgattgctgtgtacatggctt

SEQ ID NO: 18676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacctactctggtaagcgtcatactgcta

SEQ ID NO: 18677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacctccaattgctgtaaggtctgcgtct

SEQ ID NO: 18678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaccttcggccgttatggcatgcgcgatt

SEQ ID NO: 18679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgaggctcatatgtccaacgcgggcct

SEQ ID NO: 18680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcacaagcaaaccagtcggcgctcga

SEQ ID NO: 18681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcacgttggcgggatatgccctcggt

SEQ ID NO: 18682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcactacgaccccaacccttggcgga

SEQ ID NO: 18683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcagcgagaccactttcacttccgtg

SEQ ID NO: 18684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgccatcgttcttgacttggcggtact

SEQ ID NO: 18685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcctacgttggttgttcgtttcatag

SEQ ID NO: 18686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgctctcgaccccgtgtaagacaggcg

SEQ ID NO: 18687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgcttggactgccgcatacgcccgagg

SEQ ID NO: 18688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacgtaacgacgagacgcgtgcaggtatg

SEQ ID NO: 18689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactcgctttcttgttattgtcttcgtac

SEQ ID NO: 18690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactcgggggatttacgcgatcgatcatc

SEQ ID NO: 18691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactgaccggaatcgaacaagcgtccttg

SEQ ID NO: 18692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactgctgtactgcgccctggaccctcct

SEQ ID NO: 18693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactggaggaagagtgctaagattaaccc

SEQ ID NO: 18694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactggcacggtggatgaccaccagcaga

SEQ ID NO: 18695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacactggtttaacaggatcggcagagtgtc

SEQ ID NO: 18696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacttgaaagtccatggtcctgcttgcgc

SEQ ID NO: 18697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacacttgccactgtcgacctcgcttccggg

SEQ ID NO: 18698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagaaagctcaaggaaggggtttaggagt

SEQ ID NO: 18699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagacagtcgtcgcccacctcgaatctcg

SEQ ID NO: 18700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagagcaaatttaatccagggctctattg

SEQ ID NO: 18701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagagcatcccaggctactcgttgagttg

SEQ ID NO: 18702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagatggtctctggacttgccgatgctca

SEQ ID NO: 18703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagattaatcgcgtatgatttaacactcc

SEQ ID NO: 18704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagcatcggctcttggatgcgccactttt

SEQ ID NO: 18705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagcggaaggttccaatgtgccttccaag

SEQ ID NO: 18706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagcggttatgaagagtggcgccctctgc

SEQ ID NO: 18707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagcgtctcctccttcccgtcagtctggg

SEQ ID NO: 18708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagctccacgaattcatgttgccagcgtc

SEQ ID NO: 18709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggagagcagggactgcgggtaggcggc

SEQ ID NO: 18710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggagcaagaccgctggtggtatctggg

SEQ ID NO: 18711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggagcgtacgcctccgtcagtattacg

SEQ ID NO: 18712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggcacgcacatggtgtaaccccgcggc

SEQ ID NO: 18713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggcgttcgggactcgtacacaattggt

SEQ ID NO: 18714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagggacggctggtcgtccttggcgtttg

SEQ ID NO: 18715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacaggtcggctaacgggtaataccttcgca

SEQ ID NO: 18716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagtatcggttctttccaggcaacctcgt

SEQ ID NO: 18717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagtgtaatgtcattcgacatttcaaggc

SEQ ID NO: 18718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagtgtgggtggaactaagagcgctgctt

SEQ ID NO: 18719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacagtttcgtgatcatgtcgagtatgagga

SEQ ID NO: 18720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatacccggtacgcgaagtgcacaccacg

SEQ ID NO: 18721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatataccaggtcctcagaacgatcgcaa

SEQ ID NO: 18722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatcaaccgccatatgttggcggggcgcg

SEQ ID NO: 18723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatcatttattggtacgtcggcaaaccgg

SEQ ID NO: 18724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatcccccttccctgaacggatctggatt

SEQ ID NO: 18725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatctccttccgttcgcgtatgtgcaagc

SEQ ID NO: 18726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatcttcggaagcgcaacaaggctgctgc

SEQ ID NO: 18727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatgcaatggatactgtgggttgcgcctt

SEQ ID NO: 18728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacatgcactattagcagttcacaatctccg

SEQ ID NO: 18729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacattagcaaattgatgaatcttaattgtg

SEQ ID NO: 18730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacattcccgatagtgtgaagcagtcggttg

SEQ ID NO: 18731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaaaacgttaacacattgctgcacttat

SEQ ID NO: 18732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaaagagggcatccatcgatttgcttgg

SEQ ID NO: 18733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaacgactgtcaattctcgcttgcaagt

SEQ ID NO: 18734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaacgtgacttggatgtgaatgcgtgca

SEQ ID NO: 18735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaagagggactgcctaaggggttccttt

SEQ ID NO: 18736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaagcagggtgcatttggtccggggtca

SEQ ID NO: 18737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaagcgagattgtaggacggtcaacgcc

SEQ ID NO: 18738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaatacactctgtcttgaagccgcgaac

SEQ ID NO: 18739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaatacagcgcgtaatagggttcctgtt

SEQ ID NO: 18740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaatcgggtgtgtagtcctcgtaattgc

SEQ ID NO: 18741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaatgtaagcccgatgcgatccttcact

SEQ ID NO: 18742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacatccgcgtgatcgtgaagatacgtg

SEQ ID NO: 18743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacgacgagagacgtctaggatgggagg

SEQ ID NO: 18744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacgcgagccgggaacagccaggcgtgt

SEQ ID NO: 18745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacggagttgccacatttgtgtgtgaca

SEQ ID NO: 18746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacgtgagatggagcttgcaagctggcg

SEQ ID NO: 18747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccacgttaggtatccggcacgcggatcgt

SEQ ID NO: 18748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccactagggtcagcctacatggttcttga

SEQ ID NO: 18749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccactggaataccgggccgaggctctgtg

SEQ ID NO: 18750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagcaattaggttaggttgctggctccg

SEQ ID NO: 18751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagcatcgttcacccactgcaggcgtgc

SEQ ID NO: 18752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccaggacgaccgcctttcttcaccttgct

SEQ ID NO: 18753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagtaaacggaactagttgggcagccca

SEQ ID NO: 18754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagtaaggtaaatggcccatgattcgac

SEQ ID NO: 18755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagttatgtctaatccagtctgtgtatg

SEQ ID NO: 18756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccagtttgctcttatggggatatcaattg

SEQ ID NO: 18757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccatatggaacatcctggcacactgctgc

SEQ ID NO: 18758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccatccatgcttgctcatatgaccctcgt

SEQ ID NO: 18759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccatcggtcgcgccgccgtattggttcct

SEQ ID NO: 18760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccaaaatgagacttcgctggacgcatct

SEQ ID NO: 18761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccagatcccgaacaggctgcacatggag

SEQ ID NO: 18762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccagattcgccctaagcacgaaaacccg

SEQ ID NO: 18763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccagccagccgcttctccatataaccgg

SEQ ID NO: 18764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccataccggcgtgtagcacttcattcgt

SEQ ID NO: 18765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccatcctccgggagctcaaaatgtgtgg

SEQ ID NO: 18766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccccgagtttgccatgcatgacggtcgt

SEQ ID NO: 18767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccccggctagtgtagacctcaaaggcac

SEQ ID NO: 18768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccccctcctgactcgtgcagtaatatggt

SEQ ID NO: 18769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccccttcttcacttgtttgctaaccttc

SEQ ID NO: 18770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccctggggcttcacgagtgatgctaaag

SEQ ID NO: 18771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgaggtgtgaagagacgggaacattcg

SEQ ID NO: 18772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgatgctggcacatagcttcctgcgcg

SEQ ID NO: 18773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgcatgtgaggttgcaaactctcagtt

SEQ ID NO: 18774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgctatccctggctagacaacgtacgt

SEQ ID NO: 18775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgctcctccattcgagaacctgcgccg

SEQ ID NO: 18776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgcttcttcgaccttcattcggcggcg

SEQ ID NO: 18777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgctttgcaggctgcactacccaccgg

SEQ ID NO: 18778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccggagtttcaggcgcatgcgtggcggt

SEQ ID NO: 18779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccggcaccagcacatttacctcccgtgg

SEQ ID NO: 18780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgtgtatcgacaatcgtgctgggatga

SEQ ID NO: 18781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacccgtgtttgtgcagtactgccggtaccc

SEQ ID NO: 18782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctcggatgcatagcaatacgtttcacc

SEQ ID NO: 18783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctctagttgaagaaggcttacttgtat

SEQ ID NO: 18784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctgcactcatttaccttcgagtcgggt

SEQ ID NO: 18785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctgtggaggtcacgttctcgtcaagcg

SEQ ID NO: 18786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctgttatacagatgtcgcgacctcttt

SEQ ID NO: 18787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccctttcatggcgcgcgtgcaaccacaaa

SEQ ID NO: 18788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgaccaatcaccggtgactcggatcatc

SEQ ID NO: 18789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgacgactaacggctcgattcggacatc

SEQ ID NO: 18790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgactattggtgcacagtagcggattgc

SEQ ID NO: 18791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgacttggtctgacgtcacttgccagtt

SEQ ID NO: 18792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagacacgtttacctttggcatggctg

SEQ ID NO: 18793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagaggtcagtgttccttggtttccgc

SEQ ID NO: 18794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagattcccagctcacaagtgttttag

SEQ ID NO: 18795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagcacccacctgcgctactgttatac

SEQ ID NO: 18796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagcatgatggtagacaagtggtcaaa

SEQ ID NO: 18797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgagtctgcttacttgcactttcggagt

SEQ ID NO: 18798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgatccacatacgtacggtgtgcactgg

SEQ ID NO: 18799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgatgcaaagacggtctcccctcattag

SEQ ID NO: 18800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcacgatagcctttcctggttagaagt

SEQ ID NO: 18801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcagtagccgttttaggcgtcactcca

SEQ ID NO: 18802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgccatttcccgtaaaacctttgcttgc

SEQ ID NO: 18803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgccgtgcgagtggatacgctaacgtgt

SEQ ID NO: 18804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcctcatgcgcgcggtcccctcggatc

SEQ ID NO: 18805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcgacaagtatcggtacgcctttatcc

SEQ ID NO: 18806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcgcatggtctgacgcagaggtctgtt

SEQ ID NO: 18807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcggaccatcaaggaatttctgcgtgc

SEQ ID NO: 18808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcggtcgtatcccagtccggtcttgac

SEQ ID NO: 18809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgctacacgcctgagcaaccggtctcga

SEQ ID NO: 18810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgctcgttgcgaacgattcccctcccgg

SEQ ID NO: 18811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgctggacatagggcgcgaagatcgccg

SEQ ID NO: 18812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgcttcccccgacacgaccggtcatccg

SEQ ID NO: 18813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggaccggtgactatctcttggggttca

SEQ ID NO: 18814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggagcgggattcctgtttgttgttagg

SEQ ID NO: 18815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggattgccttcgttgaatcttaagttg

SEQ ID NO: 18816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggcaacgtaacaggaaagccgtgcgtg

SEQ ID NO: 18817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggctgtgcacggcattccaggacgacc

SEQ ID NO: 18818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgggatttctcgccccgcttacaactgt

SEQ ID NO: 18819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgggttgtattccatattgctttagaat

SEQ ID NO: 18820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggtcccatctgtaggcggtcgcgggtg

SEQ ID NO: 18821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggtgcgcgaagtcgtaacggtgtcagg

SEQ ID NO: 18822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccggttgtctgggctgatgtgctgtggca

SEQ ID NO: 18823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgtgccaagtaggacattataggcatcc

SEQ ID NO: 18824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgtgttattagccgaacacagcagagca

SEQ ID NO: 18825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgttacgatctagctgtagagggctgtg

SEQ ID NO: 18826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgttatggacgatgtgttcccctgacgt

SEQ ID NO: 18827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgttctgggaggggcttgggcgtgcgcg

SEQ ID NO: 18828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccgttcttaaagcgaagaggtaagtgtac

SEQ ID NO: 18829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctacctccgccaagaacaacttgtactg

SEQ ID NO: 18830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctacgatcaatcgacttcggatcacacc

SEQ ID NO: 18831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctactgcatgaccggttaaaccgctgat

SEQ ID NO: 18832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctagatgtcgctgctgtgggatgtgttt

SEQ ID NO: 18833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctagcgaccccgttaaatggcactccgc

SEQ ID NO: 18834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctatagacggctgtgtgatctcggatct

SEQ ID NO: 18835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctatcaattaactttcacttcgatcaac

SEQ ID NO: 18836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcctgagtgatgaccaggttgtagggc

SEQ ID NO: 18837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcctttatgcccggcgagacagtcatc

SEQ ID NO: 18838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcgagactcgcccgtcctcttcgaagc

SEQ ID NO: 18839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcggaaatgcagccgtacctcacccac

SEQ ID NO: 18840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcgtccgtagttgcttgccgttaagcg

SEQ ID NO: 18841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctcgttcgtcatgcttaatcaacctgtg

SEQ ID NO: 18842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctggggcacatacccctcagcaccgagt

SEQ ID NO: 18843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccttaccaggatattgatgtgcttcccta

SEQ ID NO: 18844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccttgcacgtatggcgaaccacgggcttg

SEQ ID NO: 18845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaccttgtcgcgcgatatgtggtcagataga

SEQ ID NO: 18846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctttagattccacacccagtttacgact

SEQ ID NO: 18847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctttccgcgaactattcgggtccacggc

SEQ ID NO: 18848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacctttgcaccctggtccgtattacggtga

SEQ ID NO: 18849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaaccagtgaccgtgtgcgctattgaat

SEQ ID NO: 18850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaactattattcagccgctgtgggttcg

SEQ ID NO: 18851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaagctgggatgatatggtgttcgacaa

SEQ ID NO: 18852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaaggacggggacaggaagagctagttg

SEQ ID NO: 18853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaatctcctgttgggtcctcaagcttga

SEQ ID NO: 18854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaatgatccagcctgttaggtttgagtg

SEQ ID NO: 18855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacaggattgcatcccttcggtctgcgg

SEQ ID NO: 18856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacaggcagttgttcctaggttaggttg

SEQ ID NO: 18857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacccgcaccttagactccgctcgacgg

SEQ ID NO: 18858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgaccgaggcgtttggacgaattggttta

SEQ ID NO: 18859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacctcagttcgcccacgggccgcctgg

SEQ ID NO: 18860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacctgggtagatcaatgaaggcaagag

SEQ ID NO: 18861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacgatgggtcatctgtagagtgggatg

SEQ ID NO: 18862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacggttgcgcacgttaatgccactggt

SEQ ID NO: 18863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacgttacgttgcttactcggcggtgtg

SEQ ID NO: 18864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgactagaccgagaccaccccggccgttg

SEQ ID NO: 18865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgacttgaatcctccagagtcctggcgac

SEQ ID NO: 18866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagaacggtatcactcggtatcggtagt

SEQ ID NO: 18867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagcaaccggggccgggcatatgagttg

SEQ ID NO: 18868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagcgcctcgtatcagggcatttcttcc

SEQ ID NO: 18869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagctaccctacagcgactcgcataccg

SEQ ID NO: 18870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagtcaaagggtggggaaggagggtagg

SEQ ID NO: 18871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagtcctttgcggtggtcttgtctcgtt

SEQ ID NO: 18872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgagttgtctggaccaggggcatgacggt

SEQ ID NO: 18873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatatatcaggtgggcgggtctgggcct

SEQ ID NO: 18874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatcctcctgcgcgcaccaaacaccttg

SEQ ID NO: 18875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatgatagtagtcccaggtttacggcgg

SEQ ID NO: 18876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatgcggatcccaggatactgaacagtc

SEQ ID NO: 18877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatgctaatccagatcttacagggtggt

SEQ ID NO: 18878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgatggttgtttataggcatagctgatgt

SEQ ID NO: 18879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgattcggggcactacgggaatgcctcgc

SEQ ID NO: 18880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaaaagtagcactcaccggcgcactca

SEQ ID NO: 18881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaacccgttccgattatctccggggcc

SEQ ID NO: 18882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaacgaatcgccggtgttacttacgtc

SEQ ID NO: 18883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaaggacacatattagctagggggggt

SEQ ID NO: 18884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaatcaggttggcaaggtccggggggg

SEQ ID NO: 18885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcacaagtgctatgccctgctctatcgc

SEQ ID NO: 18886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcactgtcgatcggggtctcgcctgcgc

SEQ ID NO: 18887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcagatcctgctccgtactacgctttcc

SEQ ID NO: 18888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcagccctggttgaagttgtgagggaag

SEQ ID NO: 18889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcaggtccgagccatagcgttagatccc

SEQ ID NO: 18890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcagtgcggcaacagttttcttgcaact

SEQ ID NO: 18891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcataccatcccggtaacggcttttcgt

SEQ ID NO: 18892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcatgaaacacgaggcgcagccttcgcc

SEQ ID NO: 18893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcattaggctatgctagatcgcgtaccc

SEQ ID NO: 18894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcattcaacatgctagcgctggatcatg

SEQ ID NO: 18895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccactatagtcacaaaatgcagaatag

SEQ ID NO: 18896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccaggcgcagttccaccagcacctgtg

SEQ ID NO: 18897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccagttctcggtcctcatcctctgcgg

SEQ ID NO: 18898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccccggacacccacatctgcccgcaga

SEQ ID NO: 18899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccgcataccgctcattggtccgggcac

SEQ ID NO: 18900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgccgctcgtgacccccctgctccctcgg

SEQ ID NO: 18901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcctatcgtacgcacctattggtgtcct

SEQ ID NO: 18902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcctctgcaccacaagcacccactcagg

SEQ ID NO: 18903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgaacagcaggtcatctactggcactc

SEQ ID NO: 18904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgaagattacctgccacacccaagcgg

SEQ ID NO: 18905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgatgtgattggagtgcggtcagcttg

SEQ ID NO: 18906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgcaattatccgggcctactgtacatg

SEQ ID NO: 18907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcggtacagaatcgggttgaggcgctaa

SEQ ID NO: 18908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcggtactaacgaacgcacgaaggtttt

SEQ ID NO: 18909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgtagataagttagctggtgcgcagcg

SEQ ID NO: 18910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgtattgctattctgtcgattcattaa

SEQ ID NO: 18911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgtcgctcgtctgtagttcggtttaac

SEQ ID NO: 18912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcgttagcagttttctggggtctcgggc

SEQ ID NO: 18913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgctcatagcatatcatcaccgccgactg

SEQ ID NO: 18914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgctctcgtctatgttaatggactatcct

SEQ ID NO: 18915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgctgtctcaacaagggaatgtttgactc

SEQ ID NO: 18916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcttctgactgacgctaggtccttctac

SEQ ID NO: 18917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgcttttgttttaccaatcgtttttggtg

SEQ ID NO: 18918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggaaactactgggcatgcagcgccgctg

SEQ ID NO: 18919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggaagcattgcggacgatacagaagtta

SEQ ID NO: 18920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggaagtaagggttgtgttaacacaccaa

SEQ ID NO: 18921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggaccgcccaagcagcgtatcgcagata

SEQ ID NO: 18922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggacggcatgagttggtgtaaaacggcg

SEQ ID NO: 18923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggacgtgtctgcgtgatcgacggccatt

SEQ ID NO: 18924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggagagttccatacaaggcaccatcagg

SEQ ID NO: 18925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggagcagggcggcagccagcttgactgc

SEQ ID NO: 18926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggagggaaagcttattcaaacgcgaggt

SEQ ID NO: 18927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggaggtaccagcgtcaccgcgatttgac

SEQ ID NO: 18928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggatggattgacctgggaacgtgacgtc

SEQ ID NO: 18929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggcagtccgggtgtgttaaattccgcga

SEQ ID NO: 18930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggccagctgtcatggagcagctcctttg

SEQ ID NO: 18931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggcgctttcatgcggtcggagtatccgt

SEQ ID NO: 18932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggcgtcgatgcggttgacacctcgacca

SEQ ID NO: 18933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggctaacgcgatgtgacaggcagcaatc

SEQ ID NO: 18934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggctcgtgcattgaattaagttgagacg

SEQ ID NO: 18935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggaagctgcgaagacgggcgtcatgat

SEQ ID NO: 18936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggaggcgcggtctttggatgttaacgc

SEQ ID NO: 18937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggatgtatcgcacaatgttctgtagta

SEQ ID NO: 18938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggcagcggagtatttcagagcaaagat

SEQ ID NO: 18939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggcagggattacccgtaacatttagac

SEQ ID NO: 18940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggcgagtctagcggctagccataaacg

SEQ ID NO: 18941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggcgtggggtcagtcgattccctatcg

SEQ ID NO: 18942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggacaagcttggagatcgtgattggg

SEQ ID NO: 18943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggacgcgctgactttctgacgactcc

SEQ ID NO: 18944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggcgacatataagaggtatgtccgta

SEQ ID NO: 18945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggcgatcactaatgcagtagttccgc

SEQ ID NO: 18946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggctccccgttatacatcccttcctg

SEQ ID NO: 18947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggtctacctcttatggcgatccctct

SEQ ID NO: 18948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggggttagagatcgcgcaggtgttatga

SEQ ID NO: 18949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggtgagaagctggtgcttagtaatgcc

SEQ ID NO: 18950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggtggagctgtcggggcccatgctact

SEQ ID NO: 18951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgggttcacttctgcgatcttgaccttcc

SEQ ID NO: 18952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtagcccccactagatgcataatagga

SEQ ID NO: 18953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtagtcctccgccttccacatacgtgt

SEQ ID NO: 18954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtattgttaatgcagtaggcgcaaaga

SEQ ID NO: 18955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtcacaagtcgggcggtccgcacaatc

SEQ ID NO: 18956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtccacggtggagcttgattagtgcaa

SEQ ID NO: 18957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtccgggcggtaggttccaggccaact

SEQ ID NO: 18958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtcgagattgaatgatacgccgaacgg

SEQ ID NO: 18959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtcttgtagatgtcatcattgtccccc

SEQ ID NO: 18960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtgcacacccacagtcgtccaatcttc

SEQ ID NO: 18961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtgcgcggatttgcttcattttggtcg

SEQ ID NO: 18962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtgtgacacagtgcttgctaggttgta

SEQ ID NO: 18963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggttccgaggtaaggtttttgggagagt

SEQ ID NO: 18964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacggtttcttccatcgtacatttctggacg

SEQ ID NO: 18965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtaaactgattttcattgatccgccgtg

SEQ ID NO: 18966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtaacagttgagtggagggctaattccc

SEQ ID NO: 18967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtacgaacaataccgcgtggggttggat

SEQ ID NO: 18968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtacggacctaaggtggaagcggtcctg

SEQ ID NO: 18969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtacggatccagatctgggccccgtatc

SEQ ID NO: 18970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtacgtacttctacatcggctacaagcc

SEQ ID NO: 18971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtactcaggacgtttttggactaaggta

SEQ ID NO: 18972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtacttatgagtgtttttgcgacaggct

SEQ ID NO: 18973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtagtacgggctattctaaatgggaacg

SEQ ID NO: 18974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtatatgcacttcgcccacctctgcgat

SEQ ID NO: 18975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtatgcgtaacatctccgctagcccctt

SEQ ID NO: 18976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcaaggtgggcgacggtcgaatcccat

SEQ ID NO: 18977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcaataaactgccggatcgctaacaat

SEQ ID NO: 18978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcaatcaaagtcggttttcgcggatgg

SEQ ID NO: 18979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcccttagctcctgcctgatagagtaa

SEQ ID NO: 18980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtccgccgaggttggatggttcggtgct

SEQ ID NO: 18981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcgtacgtattgactaagctcacctga

SEQ ID NO: 18982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtctcgtgtaggcgattgttggcggtga

SEQ ID NO: 18983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtctgaagcctatggcactgtctttgtt

SEQ ID NO: 18984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtcttgtactcgcgcgcgggctatggaa

SEQ ID NO: 18985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtgccctgtgttgatcagctcttcacat

SEQ ID NO: 18986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtgcgttcaccgaccgctgcgatcgggt

SEQ ID NO: 18987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtgctcaagtttgatccccgggaccatc

SEQ ID NO: 18988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtggcggctccgactgtactatgagttc

SEQ ID NO: 18989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtggggggcttcctgtacatgagaattc

SEQ ID NO: 18990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtgttattcactttttgggccacctaca

SEQ ID NO: 18991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttaagagatagtgtcggacacgcgggc

SEQ ID NO: 18992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttatgcaccgtcttacttattagcgcc

SEQ ID NO: 18993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttattaagttacgcgggtggcagaatg

SEQ ID NO: 18994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttcaggtcttccaaggggatctggtca

SEQ ID NO: 18995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttccaacacgccgtcaaaccatgcgta

SEQ ID NO: 18996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttccctgcgttcctattgcaagcgctt

SEQ ID NO: 18997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttctcgaccggctattacgttagatgc

SEQ ID NO: 18998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttctggccatgtggtagcgatgacatg

SEQ ID NO: 18999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttgatgcctagtcttgctcagtgatgt

SEQ ID NO: 19000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttggtcactactgctaagggttatacc

SEQ ID NO: 19001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgtttgtctcggtgtgcggcacgaggtgc

SEQ ID NO: 19002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttttgaatgcagatgtgaccctgctcc

SEQ ID NO: 19003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacgttttgctcacctctatcacatcttaaa

SEQ ID NO: 19004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaaacgagacctaagttaaagcacgggg

SEQ ID NO: 19005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaaagggccgccatccgtatggctttac

SEQ ID NO: 19006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaaataaccggttaacgaggtgggtagt

SEQ ID NO: 19007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaacacgtcatgctttgggcctctccgt

SEQ ID NO: 19008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaacgctactagtaccagggattctgta

SEQ ID NO: 19009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaacgctcgttagttcgtgcgaacttca

SEQ ID NO: 19010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaagctcttatagacgacttcggtgaca

SEQ ID NO: 19011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaaggcatcaatcggcttctaaccgcgc

SEQ ID NO: 19012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaatttcgactcacccgttgcgtacgtc

SEQ ID NO: 19013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactacaatggaggagggacgggacggcgcg

SEQ ID NO: 19014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaccgatccgtgccaggttataagcagt

SEQ ID NO: 19015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactaccgcaatgattacggcgccggcacgc

SEQ ID NO: 19016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactacctaggtgtcaaacccagcccaatcc

SEQ ID NO: 19017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactacgtcacttaaattagatacgatcttc

SEQ ID NO: 19018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactactaccgtctcttggtattgtttactc

SEQ ID NO: 19019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactagtcatgggtcgtggcattatttcttc

SEQ ID NO: 19020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactagtgtacgggactagaatagcagcggg

SEQ ID NO: 19021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactataccctcagagaaaactacttacggc

SEQ ID NO: 19022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatcaccgcttgtgctggatgcttagta

SEQ ID NO: 19023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatctaccgctgaggagtcatcttaggt

SEQ ID NO: 19024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatctagcttcggattatccacgtcgca

SEQ ID NO: 19025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatgactatggaatccgctgcatctatg

SEQ ID NO: 19026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatgcacctccgcacagtatcctacctc

SEQ ID NO: 19027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatgccgaacgctgcttcagaccctcat

SEQ ID NO: 19028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactatggttgtggattgcgtctgtggcgta

SEQ ID NO: 19029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactattcaccggacgttgtaaaaatcagag

SEQ ID NO: 19030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactattcgtagacctttgttacgagccgtc

SEQ ID NO: 19031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcacccgtcaagttattcccaacgtgtt

SEQ ID NO: 19032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcaggcgtgttgtctttggctgattgat

SEQ ID NO: 19033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcagtcgtgcgacgccaccgcggtgaag

SEQ ID NO: 19034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactccagtacctcggggatttcgtgtatgt

SEQ ID NO: 19035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcccaccagctacattgtgggtgcgatg

SEQ ID NO: 19036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcccagcatcataccccgtgaggcatcc

SEQ ID NO: 19037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactccgcgtgacgactccagcacaaacacc

SEQ ID NO: 19038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactccgttcactccggtcgtcagatacctt

SEQ ID NO: 19039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgaattcagccggtcccttgtatgtcg

SEQ ID NO: 19040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgacatgagaatctattctccggcatg

SEQ ID NO: 19041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgaggactcccgtcacctggcttggct

SEQ ID NO: 19042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgcaactgctcacttctctctcggttt

SEQ ID NO: 19043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgcaagcggtcgcgatgggcgaggccc

SEQ ID NO: 19044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgcagacagcctaagggtgtccggccc

SEQ ID NO: 19045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgtaataaatagtttctcgagatggcg

SEQ ID NO: 19046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgttagctagtaaaggtgttgtggtta

SEQ ID NO: 19047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcgttctaatacctggttgttcagagat

SEQ ID NO: 19048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactctagtctcaaaactatgcggaaagccc

SEQ ID NO: 19049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactctcaatttactgcgcctggtgatcctg

SEQ ID NO: 19050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactctcataacagggacgtggacccagcgc

SEQ ID NO: 19051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactctcgcgcataactatatgacactgagg

SEQ ID NO: 19052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactctcgctacctgtactttgaggacccgc

SEQ ID NO: 19053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactcttcctaaacgctttcaaagcagcaat

SEQ ID NO: 19054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgaaccccgctcttgtcgatgactgcct

SEQ ID NO: 19055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgagcgtcaacatcgccagagcaactgt

SEQ ID NO: 19056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgaggaggtgacgttgctcacatatggg

SEQ ID NO: 19057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgcacactgagctacctcaacgagtttg

SEQ ID NO: 19058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgcaccggtgaccccaggcaatgacgtt

SEQ ID NO: 19059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgccaggctgggaacccaactggttctt

SEQ ID NO: 19060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgcctaagctcctcccgggtgagcgtcg

SEQ ID NO: 19061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgcgcgactggctctggaggtattggct

SEQ ID NO: 19062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgcgtgcggcgctcggatccgttgtcta

SEQ ID NO: 19063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggaacaacagagaaagggtttgctaga

SEQ ID NO: 19064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggaacgctacgttaaggaccctttctg

SEQ ID NO: 19065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggacactactgcatggcttgcagtcga

SEQ ID NO: 19066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggacgcctatgtaagagccggatcgct

SEQ ID NO: 19067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggggctaccgggtctttgtactgaggc

SEQ ID NO: 19068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggggtcatgtggtgaaacacgttgggg

SEQ ID NO: 19069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggggttagccctttcagacacggcgct

SEQ ID NO: 19070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggtacttgaagagttctcccgttgtgg

SEQ ID NO: 19071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggtctaatggtacgcagggttgtctct

SEQ ID NO: 19072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactggtgccgcgcaacgttagacgattacg

SEQ ID NO: 19073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgtcaggccacccctaaggcgtttcgga

SEQ ID NO: 19074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgtcatttgtagcgcatgtcatatctgg

SEQ ID NO: 19075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgtccggctaacggctgacccactctgt

SEQ ID NO: 19076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgtcgaagtcggggctcggcgagttagt

SEQ ID NO: 19077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgtgtcgcggagttgaggctacgtgttt

SEQ ID NO: 19078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgttcaagcaagtgagatacattaacaa

SEQ ID NO: 19079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactgttgaactttaggcccacagcagtctc

SEQ ID NO: 19080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttacgagtctggcaaactgttttacgtt

SEQ ID NO: 19081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttacggtccacaggcgcgtgttgttcac

SEQ ID NO: 19082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttagatgaggctccctgacgcgagtatt

SEQ ID NO: 19083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttagctgaatgtcggtcttcggcgtgct

SEQ ID NO: 19084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttcgcactgcgacttgtaagtgaccagg

SEQ ID NO: 19085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttcgtagaagcgtttcccgttgcacatg

SEQ ID NO: 19086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttcttggaccagactgctctgcgcatgg

SEQ ID NO: 19087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttgaaaatgtcactactgcgacgggctg

SEQ ID NO: 19088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttggggttatggtattttgtcgccattc

SEQ ID NO: 19089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttgtcaataaatgcccacagggcgctgt

SEQ ID NO: 19090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactttacgtacacgttccaatgggctgaat

SEQ ID NO: 19091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactttcactagctcggcgtgcgtgggcata

SEQ ID NO: 19092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccactttggccggtcaaggtttcgcatgtgcg

SEQ ID NO: 19093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccacttttgcagatgaagtcgaaaatcgatat

SEQ ID NO: 19094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaaacgcggatcttccatttcgtctccgt

SEQ ID NO: 19095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaaacttgactgttgagtagggagcctca

SEQ ID NO: 19096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaacaaggaacctcggggatgtcaacgcg

SEQ ID NO: 19097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaacgacacttctcgagtgcaattgcgag

SEQ ID NO: 19098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaactacaccgcctaatgtccgttgggga

SEQ ID NO: 19099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaacttatttcctcgcttgactgatggcg

SEQ ID NO: 19100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaagctcaaacgttcagataatccgccat

SEQ ID NO: 19101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaaggcgtgtagtatattgtccaggacca

SEQ ID NO: 19102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaagtgttttcggtacttagtgtgctcgc

SEQ ID NO: 19103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaatggatgggcgagacagtttcaaagcg

SEQ ID NO: 19104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaattttggatttatatcgtgggggtcat

SEQ ID NO: 19105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacacggagaggaaggctaggtcctcagc

SEQ ID NO: 19106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacacttacgcttattatttggctaggtt

SEQ ID NO: 19107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacaggttcatacaaattccgcgtgtgtg

SEQ ID NO: 19108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacagtgcgcacaccgatttaatcgtggt

SEQ ID NO: 19109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacatcacgggggaaaaaccgacgcacgc

SEQ ID NO: 19110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacatctagattggcatagcggccctctc

SEQ ID NO: 19111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaccacaccagtacaagatccgatgctgg

SEQ ID NO: 19112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacccaggggaatcgcttcactccaattc

SEQ ID NO: 19113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaccccaccagtggcaacactatccgctg

SEQ ID NO: 19114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacccgacaagactgggagcggtaacagt

SEQ ID NO: 19115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaccctttgcggccgccacctgctagcgc

SEQ ID NO: 19116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagaccggttcatacattggcatcatgaagg

SEQ ID NO: 19117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgagacgggcgacccttaccgaacggc

SEQ ID NO: 19118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgagatgttgtacgtcagtctgcgagc

SEQ ID NO: 19119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgccaatgtgcttctctcgctacctgg

SEQ ID NO: 19120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgcgcgatatagcgacctgcgcgtttt

SEQ ID NO: 19121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacggctatttccaacgttatgtaacaga

SEQ ID NO: 19122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgggactattttcatggcttagcgatg

SEQ ID NO: 19123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacgggtaagcttcaaggtggatcgctca

SEQ ID NO: 19124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagacggtgccttaaagtcttacacatacgc

SEQ ID NO: 19125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactcaatgggcgatgctgccatgtttga

SEQ ID NO: 19126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactcagtggggttgtctacgctctgcca

SEQ ID NO: 19127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactccgggctttaaatgtcgcgtagggt

SEQ ID NO: 19128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactcggcccttgtactagtaacgcggac

SEQ ID NO: 19129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactgaacttgtccacctctcggttggca

SEQ ID NO: 19130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactgcagcaggccgggtcgcatattccg

SEQ ID NO: 19131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagactgcaggataggggtgggcaggcctcg

SEQ ID NO: 19132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagactaggcgcagttatcgatactaccg

SEQ ID NO: 19133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagagctgatgtcgtcccgtgatgttggt

SEQ ID NO: 19134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagatctgccagtgtaagttagggtgcgc

SEQ ID NO: 19135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagatgggacagagtgtacggcacagctg

SEQ ID NO: 19136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagcgcaatgagtggaagtccagctcccg

SEQ ID NO: 19137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagcgtaaggggccttttaaagcgctaat

SEQ ID NO: 19138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagggacacagactgacatcgtgctggtg

SEQ ID NO: 19139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagggccgtgtcattgagcgggattttgc

SEQ ID NO: 19140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagtccgttaccaattcttagcgagtcgc

SEQ ID NO: 19141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagtggctgcaacaagacaagtgcggggc

SEQ ID NO: 19142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagagttcgtcggatagagcaccggcaatag

SEQ ID NO: 19143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagataaagtcaatgatctgtaagtgtggaa

SEQ ID NO: 19144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatagcagccgtatccggctgttacatac

SEQ ID NO: 19145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatcccacaacctgcgacttagcccaccg

SEQ ID NO: 19146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatcccatgccgcgggcgaggtcgtccgt

SEQ ID NO: 19147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatccttcgggtccgattatctgcggggt

SEQ ID NO: 19148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatcgcgccgataagtgtgccgccgacac

SEQ ID NO: 19149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatcggatggatacgtattctctgctacc

SEQ ID NO: 19150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatctgcagcgaaagtggagggttaccga

SEQ ID NO: 19151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatgccaagtaaggggttggatgcgtggc

SEQ ID NO: 19152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatggcaggacagtggatggttgtggctc

SEQ ID NO: 19153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatggggcttgtgcacttgcttgatacgc

SEQ ID NO: 19154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatgtacctacaacctcaagttagggtcc

SEQ ID NO: 19155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatgtcctcttattacgcggtaaccaagt

SEQ ID NO: 19156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatgttagtttctctcgtcaacaccgcga

SEQ ID NO: 19157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagattaccgcatgccatctccttgtcttgc

SEQ ID NO: 19158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagattgtttcggtgtgcaaggcatggtttt

SEQ ID NO: 19159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatttaactcgttaaaggtcggggaggtg

SEQ ID NO: 19160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagatttgcttatccgcacgaggtgttgtac

SEQ ID NO: 19161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaaagtgattcttacgtccctcatgaac

SEQ ID NO: 19162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaacatgcggaggacatgacacgatctg

SEQ ID NO: 19163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaagcaggcaagaaagacagcaatgtgg

SEQ ID NO: 19164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaagggtcgcacggccttgggcattcga

SEQ ID NO: 19165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaaggtgaaacgaacgtttagtgttatg

SEQ ID NO: 19166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaataaggccacgcaagcattccacgcc

SEQ ID NO: 19167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaatgtccattgcttgttagcactgtgc

SEQ ID NO: 19168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacacgcggaaatttcctcttgggaacg

SEQ ID NO: 19169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacagaggtactcgtcttgaaaatcaca

SEQ ID NO: 19170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacaggtcagtcgacacactttgtgctt

SEQ ID NO: 19171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacattacggcgggttgtcactaagatt

SEQ ID NO: 19172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcaccattccctttaattacgctggcggg

SEQ ID NO: 19173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacccgtgttgcacaatcaccctttatc

SEQ ID NO: 19174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacctaagttctgctttaccgccggtcc

SEQ ID NO: 19175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacctttgggaatgatgttctgggcagt

SEQ ID NO: 19176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacgggcagatgtaccttggaggatgcg

SEQ ID NO: 19177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacgttacttaatggtacctgtctgatc

SEQ ID NO: 19178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcactaaatactagttgcacgggttggac

SEQ ID NO: 19179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcactcacgacggtccattacacgggtcc

SEQ ID NO: 19180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcactcgcccatcgcacatctcggtgtgt

SEQ ID NO: 19181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcacttgcttgcgtaggtttctgactctg

SEQ ID NO: 19182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagactttgaattccagagctagcggag

SEQ ID NO: 19183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagagaatgtccctgcaggtgctgcctt

SEQ ID NO: 19184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagattcatgatttcctggcaagccttg

SEQ ID NO: 19185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagattccgttcgcagcgattgatgtcc

SEQ ID NO: 19186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagcacctcgttcgttaacccatgagag

SEQ ID NO: 19187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagcactatgttgggtcggattgttgcc

SEQ ID NO: 19188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagcgaactagagcacggcccatccctc

SEQ ID NO: 19189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagcgcaaaagcttctcgttcgccggcg

SEQ ID NO: 19190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagctaagatggcgtgatgctaggtgtt

SEQ ID NO: 19191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagggaaacaccttccaagttccgttca

SEQ ID NO: 19192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagtagttttgggcacgtatatactggc

SEQ ID NO: 19193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcagttttccgcaggatttcctcgggtcg

SEQ ID NO: 19194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcatagccacatcgttggagagatttctt

SEQ ID NO: 19195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcatcccgttgtcgtcagccattccgaga

SEQ ID NO: 19196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcatgcacgctgctagtgacaatcttgcg

SEQ ID NO: 19197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcatggcgattctgaagtttggattattg

SEQ ID NO: 19198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcattaacatagcttgttatgtgtcagct

SEQ ID NO: 19199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcattcaccagaatttacatttacgcctt

SEQ ID NO: 19200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcattgatttttttcggcccttattgcgc

SEQ ID NO: 19201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccaacacaaggtaacacggcacgactcg

SEQ ID NO: 19202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccaactacgaatcctatagacgcgtgac

SEQ ID NO: 19203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccaagcaccaatcgtttatcggccaatc

SEQ ID NO: 19204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccacacgcgattacatcgacttgttatc

SEQ ID NO: 19205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccacccacggcggacgtacaactgagtt

SEQ ID NO: 19206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccaccgcggattgtaggtcgtcatttga

SEQ ID NO: 19207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccaccgcttttttgccttgatctagcga

SEQ ID NO: 19208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccacgcgagttagatcattaaactttct

SEQ ID NO: 19209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccacggaagcggcttatgcattgccact

SEQ ID NO: 19210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccactattctgccacgagtgctctggtc

SEQ ID NO: 19211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccagacatgtataacgccgctgcgctgt

SEQ ID NO: 19212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccataagtgcactgataagcagctgatc

SEQ ID NO: 19213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccatagaaggaccgttccgccgtgcctg

SEQ ID NO: 19214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccaactttaccgtattcagattgggag

SEQ ID NO: 19215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccagtggaatcgcgcggatcgtgtgat

SEQ ID NO: 19216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccccaatcacgtttgtctctggtagtg

SEQ ID NO: 19217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccctcctaggatgcccaactcatcagt

SEQ ID NO: 19218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccggtttatttttacgcgaaacctacc

SEQ ID NO: 19219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccctgccgacgattgagcgtgatcttat

SEQ ID NO: 19220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcccttcaaatctctgactcccattctgc

SEQ ID NO: 19221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccgctgtctaggaggtgagggttgagtt

SEQ ID NO: 19222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccgggatgtgggatagaggtggtggagg

SEQ ID NO: 19223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccgtggagcagtaccctcatgtttgaac

SEQ ID NO: 19224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccgttgaagagggtcagtctaaacgtac

SEQ ID NO: 19225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctcacagcctccctacgcagggcctta

SEQ ID NO: 19226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctctccctcagaagccgccggaacctc

SEQ ID NO: 19227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctggatgttagacactcgccagggaac

SEQ ID NO: 19228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctggggcgggaattgcaatgttagagc

SEQ ID NO: 19229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagccttgagattgaggtgggccatcacatc

SEQ ID NO: 19230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctttccccattatggtcaccagacgtc

SEQ ID NO: 19231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcctttgtcctaattacgagtttgcccaa

SEQ ID NO: 19232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgaaagggtctacccggagtgtagtgca

SEQ ID NO: 19233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgaaatgcggccaccgtccgcccctgtc

SEQ ID NO: 19234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgaacgtatacgtgtttaccagtacgcg

SEQ ID NO: 19235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgaagactatcatgctttgcttactatt

SEQ ID NO: 19236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgaagtaggcaagcgacgtcaactgcgg

SEQ ID NO: 19237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgagctggtctaggggtatgcccggaga

SEQ ID NO: 19238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgatgatcctgtcggtatctcacctcct

SEQ ID NO: 19239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgcaaccgggcaagtcagggatcacgtt

SEQ ID NO: 19240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgcaaccgtgtcccacctatttaggatc

SEQ ID NO: 19241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgcccagtactcactctatcccaatgtt

SEQ ID NO: 19242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgccgcgtttgcagggaagccgtcgcac

SEQ ID NO: 19243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgctatcccatacttcttactcaacggc

SEQ ID NO: 19244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgctctgcggtgtcaactacgtgcaagg

SEQ ID NO: 19245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggaagtattgcagcacccatgtggtcg

SEQ ID NO: 19246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggaatcttttctagacgcctcggttta

SEQ ID NO: 19247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggcatcgagcgattggcgtcgctatac

SEQ ID NO: 19248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggcgacacgagctgagtgtaatccacg

SEQ ID NO: 19249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggctacattattcccggtctagtttct

SEQ ID NO: 19250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgggaaatgctagacctggggctccatg

SEQ ID NO: 19251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgggacgtatctttctgactatcaagag

SEQ ID NO: 19252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgggcctctctccgcacttacttggttg

SEQ ID NO: 19253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgggcgaggggagggcaactgcataacg

SEQ ID NO: 19254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggggcactgacttctcgaatatcggtg

SEQ ID NO: 19255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggtattaccggcagtggtggggttctt

SEQ ID NO: 19256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggtgcgatggtagaaggactgcatatc

SEQ ID NO: 19257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcggttttatgtcgttctacagtgcacct

SEQ ID NO: 19258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtaagtctcatggttgcgtcaatagcg

SEQ ID NO: 19259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtagctgtgaagctgcgccagtactac

SEQ ID NO: 19260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtataagccttacgtcggccgagtccg

SEQ ID NO: 19261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtcacggtggtccgggcacaattgggg

SEQ ID NO: 19262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtccggatccatcttacatcggttgcc

SEQ ID NO: 19263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtcgcagacataagtgtctcctggcta

SEQ ID NO: 19264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtctccatccttccaggctgtggcggt

SEQ ID NO: 19265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtcttagcggtgggtcgggccccggtt

SEQ ID NO: 19266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtgagggtagacgtcgtcaagaggagg

SEQ ID NO: 19267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtgcggacagtcgaatattcgggtatg

SEQ ID NO: 19268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcgtttttgctagagttagggcagtactc

SEQ ID NO: 19269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctaccttgctagggcatgactgcggcgg

SEQ ID NO: 19270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctacggcttgaaggcctcagggttgggt

SEQ ID NO: 19271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctagcaaggtcggccgcaaaccgtctcc

SEQ ID NO: 19272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctagtcggaaggtactacctgtttggtt

SEQ ID NO: 19273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctagtggacacgtcacacggctcactat

SEQ ID NO: 19274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctatgtgtaacgaaaccatctgtgcgat

SEQ ID NO: 19275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctatgttcgtggacccgcaaatctcgag

SEQ ID NO: 19276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcaggtggaaaccaggttacggagatc

SEQ ID NO: 19277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcataccatttacggtcagggttaacg

SEQ ID NO: 19278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctccaggaataagagagtgccgtaaaac

SEQ ID NO: 19279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcccatacgtcgttagtggctagagtc

SEQ ID NO: 19280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctccggcaaatccctggtccggcagctt

SEQ ID NO: 19281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcgaccacaagtgggagccaagggtgg

SEQ ID NO: 19282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcgtcactcgccgcttaaccagggggg

SEQ ID NO: 19283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcgtttgggccgtttaacactctcacc

SEQ ID NO: 19284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctctcgttttcttagcttcccaccgtgg

SEQ ID NO: 19285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctctggcctcgtcttttaatttgaaggc

SEQ ID NO: 19286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctcttctaggtgtgtgtcttcttgaggc

SEQ ID NO: 19287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgagacggtcggccgtgtgtttcgact

SEQ ID NO: 19288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgcatgtatacggcaggtgcctcgtga

SEQ ID NO: 19289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctggatgtgccgaggtttatggtcctgt

SEQ ID NO: 19290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgggacgcatgcagcagtcttacgccc

SEQ ID NO: 19291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgggcgtgatgggaatatgcagcgggg

SEQ ID NO: 19292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgggtacaactcggacctttctggggc

SEQ ID NO: 19293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgggtactattcccgaatacttggtct

SEQ ID NO: 19294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgtataatatttctaggcctgcgcacc

SEQ ID NO: 19295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgtcgcgcattagcccacgtgctttct

SEQ ID NO: 19296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagctgttgcacttgtgtctattctgtgagc

SEQ ID NO: 19297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcttatcgacctagggctcgtaccgcttt

SEQ ID NO: 19298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcttcatcggaacggcagaccttgtgccg

SEQ ID NO: 19299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcttgattgcaggttgaatcatcagggag

SEQ ID NO: 19300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagcttgggcagctctaatccccctcgtaga

SEQ ID NO: 19301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaaccttaacgggagtggcagagttgga

SEQ ID NO: 19302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaagcagagggaaaatgcgtgcggtggg

SEQ ID NO: 19303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaagcctcaccatatctgcgtagggtgc

SEQ ID NO: 19304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaatgaacgtgttagcagtctacccacc

SEQ ID NO: 19305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaatgtgtggatcttccttcgccctttc

SEQ ID NO: 19306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaattccgctgtaccggacaagctcctt

SEQ ID NO: 19307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaccaaacacgtggcgactcttggcgtg

SEQ ID NO: 19308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggacggcgcggcactgaatctctagcgct

SEQ ID NO: 19309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggacgtacggcgattacacggcacactgc

SEQ ID NO: 19310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggacgttctgcgtcggtatccctcgcgct

SEQ ID NO: 19311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggacttgcttggatgagtaactcggatcg

SEQ ID NO: 19312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagaacgagcggtgtgtcatggccatct

SEQ ID NO: 19313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagaattgatgtcatgttcacgaatgtt

SEQ ID NO: 19314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagaggatactctgtataaccaggcgcc

SEQ ID NO: 19315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagcaccacagtcggtgagtttataccg

SEQ ID NO: 19316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagccatgagcagctttgaatggtctcg

SEQ ID NO: 19317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagcgagtcggtttacaccgtgcttgtc

SEQ ID NO: 19318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaggatcgcgtcgagccggtggtcatgg

SEQ ID NO: 19319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaggcaatcaccgcggtctcgatacggg

SEQ ID NO: 19320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaggcgactcgcgatgcacatagcgcgg

SEQ ID NO: 19321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaggcgcgctatggacgtcgtgtgggcg

SEQ ID NO: 19322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggaggtctgctcggtgggtcgtattggat

SEQ ID NO: 19323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggagtggcgttgcgaaacgttcgggttga

SEQ ID NO: 19324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggatagggatgcctgccgactaaagccca

SEQ ID NO: 19325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggatccgtgctaagcccgcgcttattcct

SEQ ID NO: 19326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggatgtagtggcagcgtgttctgtccacg

SEQ ID NO: 19327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcaactcgtgggaaatatgttgtgcgca

SEQ ID NO: 19328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcaagtcgtgccacgatcaagcggcggg

SEQ ID NO: 19329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcaccacgtcttcttgaaatcaggctcc

SEQ ID NO: 19330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcaccttttgtcatgcgagctacacctc

SEQ ID NO: 19331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcacgtacaccttcgcccgcagctacga

SEQ ID NO: 19332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcagatttgacctgtaaacgctgtagat

SEQ ID NO: 19333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcagcatatgtcagcccatacacactct

SEQ ID NO: 19334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcagtatacggactcattgcgctacggg

SEQ ID NO: 19335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcagtttattctattcctaatattgctt

SEQ ID NO: 19336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcataggggacctttggggtatccgcgt

SEQ ID NO: 19337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcatatgtcaggatttgcgatgtgcggc

SEQ ID NO: 19338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcatccgctcgacatggctcttcacggg

SEQ ID NO: 19339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcattgggttatctggattaagagcggc

SEQ ID NO: 19340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggccagcacgtgggtcagagcccttacca

SEQ ID NO: 19341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcccagtcgtgggtttttatggggggcg

SEQ ID NO: 19342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcccggggtagaggtttagtgtccggtt

SEQ ID NO: 19343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggccgcaagtgtagccttcgtgcggtgcc

SEQ ID NO: 19344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggccgtagtgatgcgtcaacgcagaccac

SEQ ID NO: 19345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcctggttcggacgcagttgccacacga

SEQ ID NO: 19346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgacatcccgaactcacgccccatgtg

SEQ ID NO: 19347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgacccgggtttctgcacacgtgttcc

SEQ ID NO: 19348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgacttacgaaagggcagcgacggtgt

SEQ ID NO: 19349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgccacaccggaaagaatgtgcttaag

SEQ ID NO: 19350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgcgattcggatcttactcgcgttgat

SEQ ID NO: 19351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgcgcgcatattactcgaatcacgttt

SEQ ID NO: 19352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcggcggaggagtgcgccttttgactgg

SEQ ID NO: 19353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcggtaggtcgatttctattggtgtcgc

SEQ ID NO: 19354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcggtcgcgatagattccaaactaggga

SEQ ID NO: 19355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcggttaatcgatgataaaggtgttcct

SEQ ID NO: 19356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgtaggttgagttctctgcagaggcgc

SEQ ID NO: 19357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgtgaattctcgatcggagggggggtt

SEQ ID NO: 19358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggcgttacactagtcttcaagcccagtcc

SEQ ID NO: 19359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctaccccttgttctctggcatacgtct

SEQ ID NO: 19360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctagacccagggagatgcacgcgcagg

SEQ ID NO: 19361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctccttaggatgtgtacgacacggcaa

SEQ ID NO: 19362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctcgattaggaaactccttggcgctgc

SEQ ID NO: 19363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctgatgtcgtgggtgttactaccatga

SEQ ID NO: 19364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctggtttgtccgctgtccctcgctttt

SEQ ID NO: 19365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggctttatttatcgagttgccgaagtagt

SEQ ID NO: 19366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaacccatgcgcataggtgcggttgag

SEQ ID NO: 19367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaagcgactcctgataacatgtcggtt

SEQ ID NO: 19368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaagtacttctgcatcagccagcaacg

SEQ ID NO: 19369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaatcgattgttactccgtgacgcccg

SEQ ID NO: 19370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaccgataaactttcgaaaccgaggtg

SEQ ID NO: 19371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggacctcacacgatgtatcaggtacggg

SEQ ID NO: 19372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggacttaaggtgcgtctgcctccttcgg

SEQ ID NO: 19373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggacttatcatgcatcggctcgtgcttc

SEQ ID NO: 19374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggagatagtgagagtgccggcacagagt

SEQ ID NO: 19375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggagcaatgcggctgagagctcgtgtct

SEQ ID NO: 19376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggagccggtttagctattaccgtgtttt

SEQ ID NO: 19377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaggagatcggtagatgccctgtttac

SEQ ID NO: 19378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaggcattgatagcgttatactcttaa

SEQ ID NO: 19379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggaggtctgctttcgttgcgcttttgta

SEQ ID NO: 19380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggagtaggctgttgggcggcgtaagtgg

SEQ ID NO: 19381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggatagcgcgtgtcaggccatacaaccg

SEQ ID NO: 19382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggatcgtacagaatgtgtttttgccttg

SEQ ID NO: 19383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggattccccgcgtgtagggatgggcctt

SEQ ID NO: 19384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggattctcttggtgtaaagcttctatag

SEQ ID NO: 19385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcaagttgcgacaaaaatgttaacggt

SEQ ID NO: 19386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcacgaaggggctctgcggtagggtgg

SEQ ID NO: 19387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcagacgactgttgtccgtgtggtggt

SEQ ID NO: 19388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggccaccgtgcgtactttacggggaggg

SEQ ID NO: 19389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggccagcaagtagtcttgtgatgtcccg

SEQ ID NO: 19390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcccgataagcatgccggtgttcgtac

SEQ ID NO: 19391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggccctaattggtgcggctaattacctt

SEQ ID NO: 19392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgacctcgctgtttcctcgggtacgg

SEQ ID NO: 19393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgatctaccccgcgcttgtgaaggcc

SEQ ID NO: 19394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgcactactcgaaagtcctcggtggc

SEQ ID NO: 19395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgcgtgccttactcaggttgtgctgg

SEQ ID NO: 19396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgtgtaccgcgccgaacccgacgtga

SEQ ID NO: 19397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggcgttcgttgtttaacagtggaccgtc

SEQ ID NO: 19398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggctctggatccaacgggttactcaccg

SEQ ID NO: 19399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggaaagataggcaatctgagtttgtgt

SEQ ID NO: 19400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggaaccgaggtggccagcatatgccac

SEQ ID NO: 19401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggatacggttgctcgaattgtggattc

SEQ ID NO: 19402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggattcgcaacagtttagtgtttcgac

SEQ ID NO: 19403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggcaactcgtggttcactcagcggtgg

SEQ ID NO: 19404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggcgtgcttaattccaacgtgctcacg

SEQ ID NO: 19405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggggaacagctggggcccgtcttggggg

SEQ ID NO: 19406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggggaacgatcatgctgaccgcttgcaa

SEQ ID NO: 19407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggggagggcagagtcgacgggcgccgag

SEQ ID NO: 19408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggggtggtgagtattgtgagcagcgact

SEQ ID NO: 19409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggtaatgttgatgtcacccgctcggtc

SEQ ID NO: 19410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggtggcaataaaagcccgggcaggcac

SEQ ID NO: 19411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggggttaggtagatacgaatctttcagtg

SEQ ID NO: 19412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtagtgctgttctcgactctgatgggt

SEQ ID NO: 19413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtatgcgccgtcggtgcactgcaggtg

SEQ ID NO: 19414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtcagagaccggtccgatctcagcggc

SEQ ID NO: 19415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtcagctgcatggccgccgcgtcaccg

SEQ ID NO: 19416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtccacaaagaatagacagtcgatgcg

SEQ ID NO: 19417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtctataacggcgcctcatcagacgcc

SEQ ID NO: 19418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtctcgggttagaggtgcaagacgact

SEQ ID NO: 19419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtggaatgccacggttattatggccgc

SEQ ID NO: 19420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtggtattttccttcgaatcgtctcgc

SEQ ID NO: 19421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtgtaatcagctcgccactcggaattg

SEQ ID NO: 19422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggttattaagttatactcgtaatagcgc

SEQ ID NO: 19423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggttggccagctctgtactatccgtgct

SEQ ID NO: 19424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagggtttagccgctagtcatgggacccgga

SEQ ID NO: 19425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtaagccgggtagtcaggctcgtaagcg

SEQ ID NO: 19426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtacggggcgaatgggagtgcaacaggc

SEQ ID NO: 19427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtactgccatcgggttgtcgtggtgcgg

SEQ ID NO: 19428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtactggctacagcggatctatgcgttc

SEQ ID NO: 19429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtaggggatcttctgccgttctgtaccg

SEQ ID NO: 19430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtatacgcgacacctgtctttggttgtt

SEQ ID NO: 19431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcaacggccgatattaagattctgacc

SEQ ID NO: 19432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcatctaaggtaacctgaaaccagggg

SEQ ID NO: 19433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcattggtttaaatcgttcgttgccct

SEQ ID NO: 19434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcgaatcatattctctctctccgtttt

SEQ ID NO: 19435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcggagaatcgagatggtcgaaactgg

SEQ ID NO: 19436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcggctaacctgtatgcccgtgtcgca

SEQ ID NO: 19437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcgggtaactctgcgagacgccgcatc

SEQ ID NO: 19438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtcgtgcatgcggatcgtgctgttgtat

SEQ ID NO: 19439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgatgtgggcgaggtttccgtgtcatg

SEQ ID NO: 19440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgcacgttcaggttcaacggggggctt

SEQ ID NO: 19441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgcagcatttggaagggttattgaaga

SEQ ID NO: 19442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgcgcaaatgcctggatagccatgccc

SEQ ID NO: 19443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgcgctccgtttactggtggctttggt

SEQ ID NO: 19444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgcgtaatttcagtgccacgtagttgg

SEQ ID NO: 19445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgctagaccgtaaagtctcacgaccgg

SEQ ID NO: 19446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgctgacgtgcaaatccgaattcgagt

SEQ ID NO: 19447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgctgcaagtcccttgttgaccgtggc

SEQ ID NO: 19448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtggcgagttttctctgtccttgggagt

SEQ ID NO: 19449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtggcgcgcgagctaagggcgaaatcgt

SEQ ID NO: 19450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtggggttcagtaaaagagaagtcgagg

SEQ ID NO: 19451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgtcgctcgtgagagttccaaggtagg

SEQ ID NO: 19452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgtctctgggattcacggacccgaagg

SEQ ID NO: 19453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgtctcttttcgattattgtgttgggc

SEQ ID NO: 19454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtgttattgcgcttatccctctccattg

SEQ ID NO: 19455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggttcgttccatttaaatgcccaacgagt

SEQ ID NO: 19456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggttgatgtgtctcatgattctactcagg

SEQ ID NO: 19457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggttggtctttatcccgtcactgtagctc

SEQ ID NO: 19458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtttcgggaaccgctcgagctgttggca

SEQ ID NO: 19459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggttttatgaaacatttaaccgtacggga

SEQ ID NO: 19460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccaggtttttggcgacagtgcacccggtctac

SEQ ID NO: 19461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaaacggcggctcccagtcatcatgtta

SEQ ID NO: 19462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaacatactttagatctcataccgccgt

SEQ ID NO: 19463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaaccaggcgtggagggtagcttgggaa

SEQ ID NO: 19464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaacggtcgcaatacgatgccctcttac

SEQ ID NO: 19465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaacttatgcgtttcgggaacgtaggct

SEQ ID NO: 19466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaagaatcacggagaattactcaaaccg

SEQ ID NO: 19467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaagcgtgtgcgcgatctgttgatttgc

SEQ ID NO: 19468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaataaccggtaataatgggccacgatg

SEQ ID NO: 19469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtacagcgcgtaacgctggttcgttaggg

SEQ ID NO: 19470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaccaggcgaacgtgtgcagtcgcattg

SEQ ID NO: 19471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtacccgcaagcactcgcacagcccggca

SEQ ID NO: 19472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtacccggcgggctactccggggcccttg

SEQ ID NO: 19473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtagatgctccagtgccgtgtgtcatggc

SEQ ID NO: 19474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtagctggcgcctgtcattccaccttagc

SEQ ID NO: 19475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtagctttggctgtatagtcacttccgat

SEQ ID NO: 19476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtaggggtgcatccgatattaagacctcg

SEQ ID NO: 19477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtagggtgcgtgcaacgttcgttcctggt

SEQ ID NO: 19478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtataactatggctcggtgagatgaaggc

SEQ ID NO: 19479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtatcgcctcgctctacagcactttttat

SEQ ID NO: 19480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtatcttggagtgttagttaaagcaagca

SEQ ID NO: 19481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtatgaatggactccgctctatcaagcac

SEQ ID NO: 19482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtatgacgaacagtctaagggtggggccg

SEQ ID NO: 19483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtatggaggcatggcacggcaacgctaac

SEQ ID NO: 19484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtattgtgaattgtttgcctagttttccg

SEQ ID NO: 19485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcaaccggccgggcatgctgtcagcgcg

SEQ ID NO: 19486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcaactcacttcacgttatcatactttc

SEQ ID NO: 19487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcaatatttccccctgcacgatccgtac

SEQ ID NO: 19488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcaccgctctgtaagcgcatgttccgat

SEQ ID NO: 19489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcacgttcgatggttatgcgcacgtaca

SEQ ID NO: 19490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcactacctggttccacacatacgacga

SEQ ID NO: 19491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcagagattacgtatcatactgggctgc

SEQ ID NO: 19492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcagcccggcgttatctagaaagcggcg

SEQ ID NO: 19493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcagggcacggctcaacggtgcgtcatt

SEQ ID NO: 19494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcagtgcggcatgcacgcttccgagttc

SEQ ID NO: 19495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcatgcgacttgtagctactggctggct

SEQ ID NO: 19496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcatgtggtttatcgctggtgtctggcg

SEQ ID NO: 19497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcccgatgtgtcggccttgcctgttcgc

SEQ ID NO: 19498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtccctgagcagaaactgggggtactacg

SEQ ID NO: 19499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcccttgcgggtttgacaagttctcgtc

SEQ ID NO: 19500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtccgatcacccaactaccgcgtcaggcg

SEQ ID NO: 19501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtccggttcgcttctagacagtgcggcgc

SEQ ID NO: 19502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtccgtgtgcctctcatacggagcgaccg

SEQ ID NO: 19503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcctctatacaagctaaaacacgtcccg

SEQ ID NO: 19504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcgcccgtggtagcgctacagcgtgaga

SEQ ID NO: 19505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcgcggcatgagggtctgaagatgcgac

SEQ ID NO: 19506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcgggttgtaggaggtcaacgctttctg

SEQ ID NO: 19507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcggtggttcccgttactgctctcttcc

SEQ ID NO: 19508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcggttgcgtaactcaatcgcacaggcc

SEQ ID NO: 19509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcgtacgggctgttcaaggttagattac

SEQ ID NO: 19510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtcgttcgtcaaggatccaaatttgatct

SEQ ID NO: 19511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtctagagagaattcttgatatcagtggc

SEQ ID NO: 19512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtctatgcactcgactacgatgtcatggt

SEQ ID NO: 19513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtctgaatctcttggtctctctggccacc

SEQ ID NO: 19514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtctggtacgctccctaactcgctgcact

SEQ ID NO: 19515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgaacgattccgtaagggtgcgggtgga

SEQ ID NO: 19516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgaagctgcgtatgcctacaacgcggtt

SEQ ID NO: 19517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgactgtccgcccctgtttttggatgat

SEQ ID NO: 19518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgagcatcccgggtagacgggctacata

SEQ ID NO: 19519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgagcccgatatcggtgattttggatcc

SEQ ID NO: 19520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgaggtctcagaggcgggcactcatatc

SEQ ID NO: 19521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgcagctgagaagctcaaagatgaccgc

SEQ ID NO: 19522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgcatacaatcaaccacataagaaacga

SEQ ID NO: 19523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgcattgcgtccacgtgttcagtgccgc

SEQ ID NO: 19524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgcccgagactacgagtaccttcaggga

SEQ ID NO: 19525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgctccaccagggatccgttcgtgttcg

SEQ ID NO: 19526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgctcgagtctgtgttacaattaagggc

SEQ ID NO: 19527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgctgatgatggctatgtgatgtatggt

SEQ ID NO: 19528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgctgccagccaggaatttctgcacata

SEQ ID NO: 19529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgcttttccgcatgcgggttctcacgat

SEQ ID NO: 19530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggaagtcaacaagggagtcgcgcgtag

SEQ ID NO: 19531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggaccgtagtactaccggtgggcagca

SEQ ID NO: 19532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggatgctttacgggtatggaacttgtg

SEQ ID NO: 19533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggattaagacaagcgagcctcctcatg

SEQ ID NO: 19534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggcaactccgctaagtaatggggttaa

SEQ ID NO: 19535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgggaacggattcgttgtaggtcgagac

SEQ ID NO: 19536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgggctacatgcttaaccccctgtccct

SEQ ID NO: 19537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggggctacagggatggaggttggtagg

SEQ ID NO: 19538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgggtgcttagggcaaggcggtgatgca

SEQ ID NO: 19539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgggttcggcagtgtgggacacgcggca

SEQ ID NO: 19540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggtcgcgagatttttcttgccttaccg

SEQ ID NO: 19541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggtgaatgacatagcgctttacaagtg

SEQ ID NO: 19542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggttgaccctacgatggcttgtattgt

SEQ ID NO: 19543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtggttgccgccgcacatcacgaccggac

SEQ ID NO: 19544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgtacagtctctgcctcgagctgtcttc

SEQ ID NO: 19545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgtcaaatggctggggttaaccgagacg

SEQ ID NO: 19546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgtcgcacacctcaacctcccactcgcc

SEQ ID NO: 19547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgtcgtccggtaccttccgcactctgtt

SEQ ID NO: 19548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtgtgggtaccaaggtagaggtatggtat

SEQ ID NO: 19549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttaaaacggacgtgataaaaggggaggg

SEQ ID NO: 19550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttaacctctcggcactatgaatcgcaga

SEQ ID NO: 19551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttaaggaccgacatcctagggcaggaca

SEQ ID NO: 19552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttaggtgcgccacgtatctcgcgcgggg

SEQ ID NO: 19553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttagtgactcggcaaggcatctggttag

SEQ ID NO: 19554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttatctttgatcacggtttaaacagcac

SEQ ID NO: 19555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttcatggaactcggtacgggcagcggtt

SEQ ID NO: 19556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttcccaccgtgcccgttttgacgatctt

SEQ ID NO: 19557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttcctttataagtcgaaacacagctttt

SEQ ID NO: 19558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttcgtaacaagctgttgattaaccggga

SEQ ID NO: 19559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttctacccatacggatttttggtcgcct

SEQ ID NO: 19560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgagggattagcctgatgaagtggtag

SEQ ID NO: 19561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgagtgaaaccgtaagtgttgatgatg

SEQ ID NO: 19562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgcaatgcaagtgggatggccgggcat

SEQ ID NO: 19563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgcattcgaaaaacctactactcttgc

SEQ ID NO: 19564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgcgtttcagtatacctgcccgttttt

SEQ ID NO: 19565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgtccacttttgagggtacggcggggg

SEQ ID NO: 19566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgtgaatctcttcttgaggtggcgttg

SEQ ID NO: 19567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgtgtccgcggtttagggggtttgggg

SEQ ID NO: 19568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttgttgggaacatcctgctccttccgtg

SEQ ID NO: 19569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttagcgccttttcatacggcaccggtt

SEQ ID NO: 19570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttagtccgaagggttcctggagggcca

SEQ ID NO: 19571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttcgcccttgggcacgttagccgttac

SEQ ID NO: 19572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttcgcctcgactcctcactagcgctcc

SEQ ID NO: 19573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttcgtgcctcgtatctatgatagtttg

SEQ ID NO: 19574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttctcaatgcttctgcatctgcgacta

SEQ ID NO: 19575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagtttgacccacccggacacccgtttcgcg

SEQ ID NO: 19576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttttccccttacggctctcatgctagcc

SEQ ID NO: 19577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccagttttgtgtctgctttaggaatactcccg

SEQ ID NO: 19578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaaaagtgggactaggcgggtctttatc

SEQ ID NO: 19579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaacctccgacatttgcatgataagtgc

SEQ ID NO: 19580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaacgcatggttaagacctccctttagg

SEQ ID NO: 19581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaactcgtaataccgcgtgggatgcttg

SEQ ID NO: 19582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaatgatacaataattatatggaacgga

SEQ ID NO: 19583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataacagcgttggacagctttgcatatgta

SEQ ID NO: 19584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaccacttgaggtgctgatgtgcttcgg

SEQ ID NO: 19585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaccgagcgacgagccaatagggtgatg

SEQ ID NO: 19586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataacggaatcaattctacttgagttttct

SEQ ID NO: 19587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataactacatcctgagtagctacctttggc

SEQ ID NO: 19588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataaggcgggacttatcgcatacgccctgt

SEQ ID NO: 19589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataagtcctcaagaactcgtttggggctgg

SEQ ID NO: 19590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataagtggatactcgcttacatacggaggt

SEQ ID NO: 19591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataatagggttaaaacataacccggactag

SEQ ID NO: 19592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataatccggggccgacaatgtacgatcacc

SEQ ID NO: 19593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataatttgagcgtcaacggttttttcaggg

SEQ ID NO: 19594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacaagcaaaaggatacacagtaagtcgc

SEQ ID NO: 19595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataccacgtcagagacgtcccccgtgcaac

SEQ ID NO: 19596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataccaggagtcatgcgcgttacgaggtgc

SEQ ID NO: 19597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataccatatgtgtctactggattgttaccc

SEQ ID NO: 19598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataccatgggtgaacgagggctccgatcaa

SEQ ID NO: 19599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataccggttcactgagcggctgtcaaggcg

SEQ ID NO: 19600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacgacccgacagcttccttccgtcgcaa

SEQ ID NO: 19601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacgccgattaggtcagccaagccccact

SEQ ID NO: 19602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacgtaatgctcgtcccgagttgcgcgcc

SEQ ID NO: 19603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacgtcacaggtctccctatgcggtggtt

SEQ ID NO: 19604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacgttactacatgtcacttgtgatgccc

SEQ ID NO: 19605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactacttggtccttttatggaataggtt

SEQ ID NO: 19606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactcggacaggctgttgaccttcccgcg

SEQ ID NO: 19607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactgagcgcttagattggggtagggctc

SEQ ID NO: 19608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactgcacgcgaccgagttcaatccctgt

SEQ ID NO: 19609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactgcatgggggtctgtattttgctacg

SEQ ID NO: 19610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactgctcatgggtcttggtgctgggttt

SEQ ID NO: 19611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactggtcaggatcggatgtgtgcactac

SEQ ID NO: 19612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatactgttgaggattcccttgttcgtttca

SEQ ID NO: 19613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatacttggattattgcgttcgcttattgta

SEQ ID NO: 19614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagaagcgagtccccgttcgatagcatgt

SEQ ID NO: 19615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagactcgcgctattgggataggaccgtg

SEQ ID NO: 19616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagacttcatcacgttcagtggcattgtt

SEQ ID NO: 19617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagagcgccgcagcttttcgggcgggtat

SEQ ID NO: 19618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagcagtgtcatgtccacatgcgctcaat

SEQ ID NO: 19619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagccggcgaagagaaggcttcgaaccta

SEQ ID NO: 19620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagcgaccggcaaagctggaaggcacggg

SEQ ID NO: 19621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagcggctgagatgtcttgccactgagtg

SEQ ID NO: 19622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggaagtacttgcacaccccatgcagat

SEQ ID NO: 19623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggacttggctagtttgcgggctttggg

SEQ ID NO: 19624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggagcgactacttacggcatgtgattc

SEQ ID NO: 19625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggcgatgcgggatttcgtggaactgcg

SEQ ID NO: 19626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagggtgcactccactcgacaaatcgtcg

SEQ ID NO: 19627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggtgacggaactctcggtagcagttcg

SEQ ID NO: 19628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggtggaacattcaagctctttttacgt

SEQ ID NO: 19629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccataggtttggttttgcgagtgtaatggacg

SEQ ID NO: 19630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagtctactgatgatcgtggtagtcgagt

SEQ ID NO: 19631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagtgagcaagacgggcatcgccggggac

SEQ ID NO: 19632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagttattaaagtttgcaatttaggtgta

SEQ ID NO: 19633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagttcacgcttcggtctgcgttatcccc

SEQ ID NO: 19634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagttccagtgtacaggccttaaccggat

SEQ ID NO: 19635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatagttgaggttcaacggtcctgctgtgaa

SEQ ID NO: 19636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatataaaagtctatattgtacgtcctttgt

SEQ ID NO: 19637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatataaggtgccaagggtcttgtttggtcc

SEQ ID NO: 19638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatacgctttagtcctcccgttgaccgcc

SEQ ID NO: 19639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatatctctcttggatatcgctgggcgtc

SEQ ID NO: 19640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatcacgttggaggctcgcatacacattg

SEQ ID NO: 19641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatcggtttgccgtcttcgtcttgcaccg

SEQ ID NO: 19642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatgcaggcgttggtgtccgttctgggac

SEQ ID NO: 19643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatgtgtcagtgcctattactgatttccc

SEQ ID NO: 19644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatgtgtgagaagaaagctcgccattcgg

SEQ ID NO: 19645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatatgttgtgtgtgtaagatgatggttgca

SEQ ID NO: 19646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatattatgtggagtaagataagaggttgtg

SEQ ID NO: 19647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatattcatcgtacgtctttgcatagtgcgc

SEQ ID NO: 19648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatattgtacgtgtgtagccgccccatgtgc

SEQ ID NO: 19649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatattttgtcctgaatgtggattcggggtt

SEQ ID NO: 19650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaaacatgtgaggggacttggttgattg

SEQ ID NO: 19651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaaacttcgggtctacggcaatgtttag

SEQ ID NO: 19652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaaatccaccgcaagagatcatagtgcc

SEQ ID NO: 19653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaacagcttggcaaatgcgccccatgtg

SEQ ID NO: 19654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaatagcgtgaactctcgctagtccaca

SEQ ID NO: 19655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcacacgatcagagggggccgggtccggg

SEQ ID NO: 19656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcacggaaagtgctcgtcgctgttggcta

SEQ ID NO: 19657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcagcagttatcgtattgctattaattcc

SEQ ID NO: 19658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcagcgaccataaaacgaggtcctatcgg

SEQ ID NO: 19659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaggcaattcgtcggtattcatcaatgg

SEQ ID NO: 19660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaggcgggagagttggactggcttgtca

SEQ ID NO: 19661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcaggctggcgaccgaccttacgagggct

SEQ ID NO: 19662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcagggaaatccggagggagccgggccca

SEQ ID NO: 19663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcagtactaacacagtgcagcgttaaatg

SEQ ID NO: 19664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcagtgcactacttcggcacgtaggtcgt

SEQ ID NO: 19665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcataagagtatgcaatagcgtggggacg

SEQ ID NO: 19666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatacatcgattggtaagtctgcgtctc

SEQ ID NO: 19667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatagcggatgattggagatccgtacct

SEQ ID NO: 19668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatcctctgcaggtctgtaggtgctgcg

SEQ ID NO: 19669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatcgcacgatccgtgaacttacccgtt

SEQ ID NO: 19670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatcggaccttggcccccatactctttg

SEQ ID NO: 19671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatgagttagggaaatccacgcggtagt

SEQ ID NO: 19672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatgccgggacgaaatctggatcgtaga

SEQ ID NO: 19673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatggatccctgccacgcgcggtccggg

SEQ ID NO: 19674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcatggtaacctcgttggattcacaagcc

SEQ ID NO: 19675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcattaggcccatccctatttgcgccttg

SEQ ID NO: 19676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccaacgtggggtgtacaagttcaaagtg

SEQ ID NO: 19677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccaatgaagtgaataggacgttgactat

SEQ ID NO: 19678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccaccggacggttagcaggcgtttgttg

SEQ ID NO: 19679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccacctccactgcgcagacgggttgtcc

SEQ ID NO: 19680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccactaagctcgatcgcattcggaatca

SEQ ID NO: 19681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccactgacatcactgttggacgggaacg

SEQ ID NO: 19682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccagcgggtaagcccagtggtaatcgcg

SEQ ID NO: 19683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccaaacaggacatacgcagcccttcct

SEQ ID NO: 19684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccaaggctatctattggtggaatatcg

SEQ ID NO: 19685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccccgggtctaggagccgaccattctg

SEQ ID NO: 19686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccccggtcagcctgctagagatccacg

SEQ ID NO: 19687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccgcgtaccggctggggtttgtacgta

SEQ ID NO: 19688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccgctgctaaacccatgacgatgtcgc

SEQ ID NO: 19689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcccggagcgaccgtctggttatactagt

SEQ ID NO: 19690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccctgcgtgtatgttccgcactgtgcgt

SEQ ID NO: 19691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgaccatcgagaagcgagaaatgctgg

SEQ ID NO: 19692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgccgtgggtgtccaaatcgaacccgg

SEQ ID NO: 19693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgcgatcgtacacgaaaactggtcttg

SEQ ID NO: 19694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgggcgggtacaaccatacgattcggt

SEQ ID NO: 19695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgtaacgaacttccggtggttgatcgc

SEQ ID NO: 19696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatccgtcgccgaggattcccgtttccctgc

SEQ ID NO: 19697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctcatatcagggatcgggatttgggtc

SEQ ID NO: 19698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctccagaatcgcgccgtaccgatcgtg

SEQ ID NO: 19699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctcgccaagtcccgatgggctctcctg

SEQ ID NO: 19700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctcgtgtcgcgctaagccgttttctcg

SEQ ID NO: 19701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctgcagaccaaatctgactctgcggtt

SEQ ID NO: 19702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcctggggtacaacccaactacgaagtac

SEQ ID NO: 19703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgaagcgcacacatttcggaacgccgcg

SEQ ID NO: 19704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgaccagtctgctcgggccgcgtggatc

SEQ ID NO: 19705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgagcactgttaaaatgctgtcttgtta

SEQ ID NO: 19706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgaggctctgcgtcccgggtattggaac

SEQ ID NO: 19707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgatcagagtgaattattggcgggtgtt

SEQ ID NO: 19708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgatgcccgaactgttttagtcgcacct

SEQ ID NO: 19709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgcaaacgtcttcgtgcatttacccgcg

SEQ ID NO: 19710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgcactttatgatgagcgtttgaaggaa

SEQ ID NO: 19711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgcgcagttggcccgggattctatcgcc

SEQ ID NO: 19712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgcgccgtgatgggaggtcgcgcttggg

SEQ ID NO: 19713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgcgtctctcttatgtgctttttaggga

SEQ ID NO: 19714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgctcacttgggtataagtgtccgtttc

SEQ ID NO: 19715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgctctttccttgtctctttcttaacat

SEQ ID NO: 19716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggacgttggttcgctttctggtcgccc

SEQ ID NO: 19717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggattcgagctcatgcttgaggaatgg

SEQ ID NO: 19718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggcaatgcgtgatctccagccgcgtgt

SEQ ID NO: 19719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggcagttcgtttcgttgggatccggga

SEQ ID NO: 19720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggcatgttttattcgataaagtcgtgt

SEQ ID NO: 19721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggcggaaggttccctctgcgtatcttc

SEQ ID NO: 19722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgggaactacctagtgcaactaaagcgt

SEQ ID NO: 19723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgggacgggagggtcatggctgttacga

SEQ ID NO: 19724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggggaccgggtaatcgatgccggatct

SEQ ID NO: 19725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcggtaactaaaaggggctcgccacacac

SEQ ID NO: 19726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtacttgcgtgttctcgctagcatacc

SEQ ID NO: 19727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtagggcgattgaaataaagtttaggc

SEQ ID NO: 19728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtcacgcgcggttcatcttccatgaga

SEQ ID NO: 19729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtctatgtcggtaagtgtccgtgtata

SEQ ID NO: 19730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtctttgagagttcagggagattagtg

SEQ ID NO: 19731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtgcatcccgtttatccctgctcgtgg

SEQ ID NO: 19732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtgcccaatctgccagtttgacgctcg

SEQ ID NO: 19733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtgggtggggaagctccctagagagcc

SEQ ID NO: 19734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgtgtagttaagtgaactagtcgagagt

SEQ ID NO: 19735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgttacctataacccgttccagcacttc

SEQ ID NO: 19736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgttaggtcttagagggtgccgacgtac

SEQ ID NO: 19737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatcgttcatgtcgaaggatttacgccgggt

SEQ ID NO: 19738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctaaatgatcatttctcaagctcggttg

SEQ ID NO: 19739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctaagactgcgtgtgtacaatacgtact

SEQ ID NO: 19740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctaatacttcaatcactcctattaggtg

SEQ ID NO: 19741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctataggaccgtctccggcaatatgtgt

SEQ ID NO: 19742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctcccaggctttcaatgaagattatggg

SEQ ID NO: 19743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctctcgtctgtctggcggtgtcaacgct

SEQ ID NO: 19744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctgagcaattgggcatcgtcttagctcg

SEQ ID NO: 19745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctgatcttagccctagagtaattataac

SEQ ID NO: 19746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctgattagcgtcggtcggcagaagcgcg

SEQ ID NO: 19747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctgcgagatcagcgtttgtagcgacaac

SEQ ID NO: 19748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatctgtagtccttgcccctagcttgccccg

SEQ ID NO: 19749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaagattcgattacgtcatgacggtgag

SEQ ID NO: 19750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaagattgaagtcaggttcgcgtgaaaa

SEQ ID NO: 19751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaagcgctcacgtgcttgaactcatggc

SEQ ID NO: 19752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaagcggtggtaggagccaagctgctcg

SEQ ID NO: 19753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaatccgagatttgctggctgggtaatg

SEQ ID NO: 19754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaatgtatgctattatccagctctgttc

SEQ ID NO: 19755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgaatttggcttgcgtgctcgaatatcgc

SEQ ID NO: 19756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgacctaagtaaacagccctgtgcgccgg

SEQ ID NO: 19757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgacgaacacagtagaatatgggaacatc

SEQ ID NO: 19758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgacgttgtaggatcacggaagtacatcg

SEQ ID NO: 19759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgagaaatgcagaggtgctattcacgcat

SEQ ID NO: 19760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgagccttggttttgcgcagagtttatgg

SEQ ID NO: 19761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgagcggcgttgtctctcgtgctacgcgg

SEQ ID NO: 19762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgagtgactctcgtgtgcacatgtacccg

SEQ ID NO: 19763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgagttctaataactccttttggttaata

SEQ ID NO: 19764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatcaccctagcaggaccccaacacttg

SEQ ID NO: 19765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatcaggtatgataggcgcctgggtgtg

SEQ ID NO: 19766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatgcgctacttcgtatccgagacagag

SEQ ID NO: 19767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatgcgttaacacaaccagccctcgtaa

SEQ ID NO: 19768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatggtgctctcgaggtaatagcccgca

SEQ ID NO: 19769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgattctcaccatgattctattgtgctgt

SEQ ID NO: 19770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgatttataattagcgcggggttttacaa

SEQ ID NO: 19771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcaattttataggagcgagtagagcgtg

SEQ ID NO: 19772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcaccgtgcgaccaccagatgttgtctc

SEQ ID NO: 19773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcataagtgttcgctcatagttaaggtt

SEQ ID NO: 19774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgccatcgtcgcactatcagtaccactcg

SEQ ID NO: 19775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgccgcggccactgatcgaactaaccaaa

SEQ ID NO: 19776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgaatccctctagcacttcaatcgtgt

SEQ ID NO: 19777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgacctggatcctgtgcacgcctgact

SEQ ID NO: 19778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgcaggcaggctcacgacttgacggga

SEQ ID NO: 19779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgcgattttcaccacacctcttactca

SEQ ID NO: 19780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcggaaccctcttatgaatgtattgggg

SEQ ID NO: 19781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcggaggggaatttcggactttcgaatt

SEQ ID NO: 19782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcggtgtgtgatccctgggggtgcaccg

SEQ ID NO: 19783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcggttggttcactggtcgtctcgcggc

SEQ ID NO: 19784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgtaacgcatcttgccaaggtgcgcgc

SEQ ID NO: 19785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgtcaaaacccggcttggcttgcattt

SEQ ID NO: 19786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgttacaccatccgtggatccgcgtcg

SEQ ID NO: 19787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgttacgggcgtttctagtattagtgg

SEQ ID NO: 19788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcgtttgatttgtttccttgtaggccct

SEQ ID NO: 19789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgctacacgcgatgacccaagcttttctc

SEQ ID NO: 19790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgctctgtgtctttcctcgcgcactctgg

SEQ ID NO: 19791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgctgacggcgtttcattatacgtcgcgc

SEQ ID NO: 19792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgcttgtggaatgcccagcgcgcacgggt

SEQ ID NO: 19793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggaaaagtagaagatcatcgctaagtcg

SEQ ID NO: 19794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggacacggcgttaattcttgcgcgaccg

SEQ ID NO: 19795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggacgacaagcgagaatcccggacggta

SEQ ID NO: 19796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggactcatggctttgacagtatgtcctg

SEQ ID NO: 19797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggagcctttctcgagggggtacgcctta

SEQ ID NO: 19798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggagttgtaagtccctcaacatcgaggt

SEQ ID NO: 19799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggatcacggggagacctgcatgcttaca

SEQ ID NO: 19800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcacgtggggactgatgactttacaac

SEQ ID NO: 19801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcagcaggtactccggcttctacgtcg

SEQ ID NO: 19802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcaggaattgaaccgtctggcaagcct

SEQ ID NO: 19803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcattaagattgtcccccttcagacgc

SEQ ID NO: 19804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgaaatcctccaggaggcttaggtac

SEQ ID NO: 19805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgaggctgctattatgacacgttcgg

SEQ ID NO: 19806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgcatatgagcattaagagttaatct

SEQ ID NO: 19807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgcctattgacacaccggccaacatc

SEQ ID NO: 19808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgtcgagagggggatggggacgcgcc

SEQ ID NO: 19809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgtggagttgcgtgcagggtacggcg

SEQ ID NO: 19810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggcgtttcgggttcatgagctttcgggc

SEQ ID NO: 19811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggatgactgtcaagagtcccgctcgtg

SEQ ID NO: 19812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggatgggtttgggttattggcgcttgt

SEQ ID NO: 19813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggccccgacgaggctaagttttccttg

SEQ ID NO: 19814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggcgacaattggctcactaagcgcggg

SEQ ID NO: 19815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggggacgcgacgatcgctcgacacgtaa

SEQ ID NO: 19816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggggatagcccttttttcaattgcctgg

SEQ ID NO: 19817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggggatcagtgcgaccgagggtctgctt

SEQ ID NO: 19818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggggcaccacgatcccaggctgttgaca

SEQ ID NO: 19819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggggtactctcattcgcgccgttaccg

SEQ ID NO: 19820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggtcacttgggatattcggtgctgtga

SEQ ID NO: 19821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggtctaatggacagatattttccctcg

SEQ ID NO: 19822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgggttctcgaccgcttctcttgccctag

SEQ ID NO: 19823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtactcaacatttgggttcgcgacccg

SEQ ID NO: 19824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtataagaaagtttgactctcaggtat

SEQ ID NO: 19825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtcaacacgggaactgggaaacgcagt

SEQ ID NO: 19826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtgatgtgacaacgtggtgcatcttat

SEQ ID NO: 19827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtgcttaggtcacccctctcaaatagc

SEQ ID NO: 19828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtgttttggtacctacgctggttgata

SEQ ID NO: 19829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggttcagactttccctttcgctgtgggg

SEQ ID NO: 19830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtttgcagcgggtcccccgatgatgct

SEQ ID NO: 19831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatggtttgttctgcccgtgtcgcccgcgct

SEQ ID NO: 19832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtaaaaagtgcattccgttatttaaatc

SEQ ID NO: 19833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtaatgaaaaattggtgttgaccgcttg

SEQ ID NO: 19834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtaccagccaccgcgttgcaattcttgg

SEQ ID NO: 19835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtacgggacgctgaaccgactcctgcac

SEQ ID NO: 19836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtagctactcccccaacgtttgcggtta

SEQ ID NO: 19837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtaggtgtgtctgagcaacagccgtctt

SEQ ID NO: 19838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtatagagtggttagctccgcttcctga

SEQ ID NO: 19839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtattgcacgtggttttcttatgtttgg

SEQ ID NO: 19840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtcacagtatctagtgtcgctgttttcc

SEQ ID NO: 19841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtcacgatttcaagacgggcaggcggcg

SEQ ID NO: 19842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtccgtgcgagagcaagtggtggcgcgt

SEQ ID NO: 19843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtcgcgctttcgacataggcgaagccgg

SEQ ID NO: 19844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtcggctctcgcacgggacttctgtaca

SEQ ID NO: 19845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtcgggggttgaactggtctttggttgg

SEQ ID NO: 19846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgaagttggaaccgatgttaggacgtg

SEQ ID NO: 19847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgaatcactccgacgcgcggttcgaac

SEQ ID NO: 19848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgagcacggtcctccgtcagttgactt

SEQ ID NO: 19849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgcagccttgtatgtggaaccgcgcgg

SEQ ID NO: 19850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgcatcaagtttgttagggtttcgcca

SEQ ID NO: 19851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgccgcgcgccacaaacgttctatggg

SEQ ID NO: 19852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtggaaataatacgagtcaacctgatgg

SEQ ID NO: 19853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtggcggcactgacatcgcacgaatgca

SEQ ID NO: 19854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtggtggtgcctgactggacacattagc

SEQ ID NO: 19855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtgtactgatggtgaacagaggtcacgg

SEQ ID NO: 19856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgttcgacgacctcaaaagagcttactcg

SEQ ID NO: 19857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgttcgcggaccccagaagattgagggcg

SEQ ID NO: 19858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgttctgatgaactacatgtggtgggcgg

SEQ ID NO: 19859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgttggtcatgttaagtgtacggctcgct

SEQ ID NO: 19860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtttatggttgctgacatgcaggtttgc

SEQ ID NO: 19861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtttcagccgtaagctctcgttcctggg

SEQ ID NO: 19862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgtttgccattccgagtaatagagtgggt

SEQ ID NO: 19863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatgttttacagcatacgagccattcggaaa

SEQ ID NO: 19864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattaatcagatcgggcgtagagcttatttc

SEQ ID NO: 19865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattacccgggacagacgtacagctattaat

SEQ ID NO: 19866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattaccttagccattcggtcccccccacgc

SEQ ID NO: 19867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattacgagatagccgtacgcaatgatagcc

SEQ ID NO: 19868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattacgtctcttccctagcgtcctccacgg

SEQ ID NO: 19869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattactacgggtgcgtgggtgctcagcagt

SEQ ID NO: 19870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattactcgtggaacgggttatcagggtggt

SEQ ID NO: 19871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattactgatgagaactgcacgtttcctaga

SEQ ID NO: 19872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattacttgcagatgcatcggagagccgttg

SEQ ID NO: 19873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattagcataccgctaaattgttggctgctg

SEQ ID NO: 19874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattagcgatcaagtgggccagcagtacgtt

SEQ ID NO: 19875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattagtagcggttgatttcgagattagcgc

SEQ ID NO: 19876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattataggttatacgttaaatcgcccgtat

SEQ ID NO: 19877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattatgagtttgtacaagtttagcttccga

SEQ ID NO: 19878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcacctttccaccgtagttgccctggtg

SEQ ID NO: 19879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcagaaagggatagagcacacacccctg

SEQ ID NO: 19880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcagaacttcgtcactcaccgctcttct

SEQ ID NO: 19881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcagggccggcggcgatctgctggcagg

SEQ ID NO: 19882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcatcgggttagcatcttcccgccgtca

SEQ ID NO: 19883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcatgtcaccgtgcgataaactctccgt

SEQ ID NO: 19884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattccagcacgtctcaggagaaagggagtg

SEQ ID NO: 19885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcccacgcttacgccatgtcactattgg

SEQ ID NO: 19886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattccgcgccagttcatgcgtctaggaccg

SEQ ID NO: 19887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattccgggaccggcgcatcgttttttcgga

SEQ ID NO: 19888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattccgggtcgcccgcgttcgatttcggag

SEQ ID NO: 19889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattccgtggacacagctatgctacgccctc

SEQ ID NO: 19890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcctaaattacctttttctaggtgggat

SEQ ID NO: 19891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcctcgcagcttgcacgtgcaagtgatg

SEQ ID NO: 19892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcgacctgttgcttgcatactcttaccc

SEQ ID NO: 19893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcgcggtctaccatcacaaaggtaattg

SEQ ID NO: 19894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcggttcccactgctcggctgttagagc

SEQ ID NO: 19895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcgtaggcgcgtcgcagcagtacctctt

SEQ ID NO: 19896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcgtcggcagtcatcctcggatgcatat

SEQ ID NO: 19897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcgtgtcgagcgcttagatttcggttgg

SEQ ID NO: 19898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattctacaggtgcaaggtttctatgccctg

SEQ ID NO: 19899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattctccgaacccggtaatttttcggcttc

SEQ ID NO: 19900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattctcggaggcgagtccccgtggtgggcg

SEQ ID NO: 19901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattctgagagtctgattgttgggaacatcg

SEQ ID NO: 19902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcttacgggtgatatcgtctccgcgtgt

SEQ ID NO: 19903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattcttgcaatgcctcgggcgccgccgggg

SEQ ID NO: 19904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattctttagtcaagtcccacgatagagatt

SEQ ID NO: 19905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgaacggatctaaaggcactcttcgctc

SEQ ID NO: 19906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgaagggagtagttcgttctttcagcat

SEQ ID NO: 19907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgactccaactcacattggtggtgggcc

SEQ ID NO: 19908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgatctttttacaactacttccgggggc

SEQ ID NO: 19909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgatgccagacgctcatgcagcctgctg

SEQ ID NO: 19910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgcaatcgaacccatcttctcttcgccg

SEQ ID NO: 19911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgccatatggtcgcgggattttgcgggg

SEQ ID NO: 19912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgccgcatcactcggcacgcgactaatg

SEQ ID NO: 19913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgcctgacacaggccttcgtctcggttt

SEQ ID NO: 19914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgcgactaccacgacacctgacgaaacg

SEQ ID NO: 19915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgcgtacaagcgtgggggaactgttcca

SEQ ID NO: 19916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgcttacgttatacaattagacgtctcc

SEQ ID NO: 19917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggaggtatagcacactagttggtttac

SEQ ID NO: 19918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggctgggcatactctgggcgctgcagc

SEQ ID NO: 19919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgggatatcttgccggggcgcaagcatt

SEQ ID NO: 19920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggggttcacggataagacagcagcttc

SEQ ID NO: 19921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggtgagagcttggccgatgggatgagc

SEQ ID NO: 19922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggtgtgggcagagatgtgttcgtttgg

SEQ ID NO: 19923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattggttcaccagccgtgggttacggcaga

SEQ ID NO: 19924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgtaaagcgaggacgccagtctgcagag

SEQ ID NO: 19925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgtaataaactacacttacatcttgcct

SEQ ID NO: 19926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgtcataacccgggcatcgagcttcgtg

SEQ ID NO: 19927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgtggattgcgtccgacgtcattcatat

SEQ ID NO: 19928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccattgtgtccagaacccgtccacttagccgg

SEQ ID NO: 19929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttaaacacgcctgcctatccaacgggcg

SEQ ID NO: 19930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttaacgttccataattagagggtattgc

SEQ ID NO: 19931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttacattccgtttgtagtggagacaagc

SEQ ID NO: 19932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttacttccgaagtgccgcgcagtactgg

SEQ ID NO: 19933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttagtcgtcgagctggagtatcggcgct

SEQ ID NO: 19934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttatgatccaggtgtgcacatctatgtc

SEQ ID NO: 19935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttattacgtttagcacgccgcggaccca

SEQ ID NO: 19936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcaacgggactctccactattggtcac

SEQ ID NO: 19937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcacagtcgaatccctatcgcgcaccc

SEQ ID NO: 19938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcactgctccgtagaggatcgttggtt

SEQ ID NO: 19939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcactgtgacgcaccagaatgattcga

SEQ ID NO: 19940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttccagccttaccctgctgcgggtggac

SEQ ID NO: 19941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcgcaagtaaccgcacctactctgcgc

SEQ ID NO: 19942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcgcaatacaagtcggccgtgacgttc

SEQ ID NO: 19943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttcgctcacccaggatgataaacgattg

SEQ ID NO: 19944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttctacactcgtgattgtaatttggcgc

SEQ ID NO: 19945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgaagacggtgtcctcagcttgggacc

SEQ ID NO: 19946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgatgatgttgctggctggtgttagcc

SEQ ID NO: 19947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgcataattaacgccttagtcggcgat

SEQ ID NO: 19948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttggaagtcagtaaggtggtttggggcc

SEQ ID NO: 19949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttggttgtaacttatgagatcttaccgc

SEQ ID NO: 19950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgtacgattctaattcgacctttatct

SEQ ID NO: 19951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgtcaccaatttagatctgttgtatgg

SEQ ID NO: 19952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgtgctagattaggagtggagagcaat

SEQ ID NO: 19953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgtgtgttcagtcttaatagcggtagt

SEQ ID NO: 19954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttgttggtcctagtttcggcatctcgtg

SEQ ID NO: 19955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttttacgaggtcatatacctaacggtgg

SEQ ID NO: 19956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccatttttccgctacaagaagccaactcagtg

SEQ ID NO: 19957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaaactgtgtcaaaccatggcttggttgc

SEQ ID NO: 19958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaaagctttgactagatgtgcgtcagggc

SEQ ID NO: 19959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaaagttgcgaggttattgtacacgataa

SEQ ID NO: 19960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaaatacggcccgcggtgagttgaatgag

SEQ ID NO: 19961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaaattgaaggtgggtatcgggtagtagc

SEQ ID NO: 19962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacacaaggtctctaaagccgtcggtct

SEQ ID NO: 19963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacatctactgtgacttttcatttgagg

SEQ ID NO: 19964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacccattgtagcaaggaaccggcagcg

SEQ ID NO: 19965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacgaagaccaatggctcaccgcgtctt

SEQ ID NO: 19966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacggggcttggctctcatgccggtatg

SEQ ID NO: 19967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaacggtgggaaagctgaaacgtacagga

SEQ ID NO: 19968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaagaacgctacgcaggtatcagatggcg

SEQ ID NO: 19969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaagaatagtcgacacgggtactctcggg

SEQ ID NO: 19970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaagcgtcaggtaaaggattcacgtgtgc

SEQ ID NO: 19971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaataaggaggtaatcgtagtctgtttag

SEQ ID NO: 19972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaataccggttgtggaccttaggagccgt

SEQ ID NO: 19973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaatgatcgagcaacgtgcgggagacttg

SEQ ID NO: 19974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaatgccatcacagttgcggatcggctta

SEQ ID NO: 19975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaatgctcatacgggaggcatgtcgcagg

SEQ ID NO: 19976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaatgctgtaacctttcttgacatgcact

SEQ ID NO: 19977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacaagtacgcgttcagagatgcccgtgc

SEQ ID NO: 19978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacactaggcagattgttgtccacccttc

SEQ ID NO: 19979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacactatcgcattctatgtttttactca

SEQ ID NO: 19980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaccaaagttgcatcaccgcgatctccga

SEQ ID NO: 19981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaccattgaaatgagtagttctgatcgct

SEQ ID NO: 19982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacccgagcacgtatggcagattgggcgc

SEQ ID NO: 19983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacccggtgttatagttggtacagcgaat

SEQ ID NO: 19984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaccgctgtgccgtagttgtccgccgcgg

SEQ ID NO: 19985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaccggttgtgtatgagaggctagctgtc

SEQ ID NO: 19986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaccggtttagcatagactgatgagtttt

SEQ ID NO: 19987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacgaacgctggtgcatagtgccttgggc

SEQ ID NO: 19988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacgctatgcttagctttcggcagtgtgg

SEQ ID NO: 19989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacgctgtctttaaacgggatcactggct

SEQ ID NO: 19990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacgtgggcaagagcggatcatcgggtta

SEQ ID NO: 19991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactaaatacggaggacagtgcgcagccg

SEQ ID NO: 19992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactaggctgcatggaatcgatttggggt

SEQ ID NO: 19993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactcgttacttgagtggcgtggttcccg

SEQ ID NO: 19994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactctcaccccaatgcggtcttgctgcg

SEQ ID NO: 19995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactcttgtgaaactccccggactggcaa

SEQ ID NO: 19996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaactgctctccgacaggatgattcccccg

SEQ ID NO: 19997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaacttacccacgttttgcaacgcgacggg

SEQ ID NO: 19998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagaccagggggaagcacattgttgtttg

SEQ ID NO: 19999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagacgatttagtgcctccttttcgtcct

SEQ ID NO: 20000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagagaaagaacggttgtgttctcgtgcc

SEQ ID NO: 20001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagagttgctcggatttcaaataggatct

SEQ ID NO: 20002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagatctgaaagggacacaactccgacaa

SEQ ID NO: 20003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcacttacggtgacgccggtcaggggg

SEQ ID NO: 20004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcagagccgtactgaggactgtgtcgt

SEQ ID NO: 20005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcaggcagctcgtcctggcgtccttga

SEQ ID NO: 20006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagccctattctagatctgcgccaaattt

SEQ ID NO: 20007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcgactgcgaaatcagcttgaaaggtt

SEQ ID NO: 20008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcgcgtaaacaagctactatgtatgcc

SEQ ID NO: 20009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagcgtggctgaacctcctaagagttgcg

SEQ ID NO: 20010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggagccgagttttgcgttaaatgaagg

SEQ ID NO: 20011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggagctgacattaggtgaggcgacata

SEQ ID NO: 20012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggatacgtcaggaggtagtgcccgcgt

SEQ ID NO: 20013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggcggaaagccgactcgagatgaagtc

SEQ ID NO: 20014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagggaggttaagcgatttatctgcgggg

SEQ ID NO: 20015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagggttatcaaactcaagcaagttaccc

SEQ ID NO: 20016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggtcgaaggacacgtgttttgtcaacg

SEQ ID NO: 20017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggtctgcttgatttaccaagatgctcg

SEQ ID NO: 20018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggtcttaacgcggtctttttctgctac

SEQ ID NO: 20019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaaggtttcatgacctagtggttgttttcg

SEQ ID NO: 20020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagtctcagtatgtatgtcgcggggtggg

SEQ ID NO: 20021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagtctgcatctccttggttttggatttg

SEQ ID NO: 20022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagtggcctcggcggttttcccactcgta

SEQ ID NO: 20023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagttatcatttacgttacttagtgctac

SEQ ID NO: 20024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaagttctcgagcgcgcgtgggttattctc

SEQ ID NO: 20025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatcacgggtggcggtaaccgcaatggct

SEQ ID NO: 20026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatcgctagacgacgttgccggactgagc

SEQ ID NO: 20027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatcggaccaaggcttgttctgttttggg

SEQ ID NO: 20028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatctacttagcttataggcgcgaagttg

SEQ ID NO: 20029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgatacgttcttatcacagtatggggc

SEQ ID NO: 20030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgcaccttatctgactcgctccctgtt

SEQ ID NO: 20031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgcagcggcattcgcacacgtggtggt

SEQ ID NO: 20032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgccagtgagggtcgagaaaacttgcg

SEQ ID NO: 20033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgctgccgataccagcttgcacattat

SEQ ID NO: 20034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatgtttatgcccaccaccgaatggggag

SEQ ID NO: 20035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaattcatttgcgggttcactgttgattgt

SEQ ID NO: 20036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaattggtaattcctccttgcacgcttatt

SEQ ID NO: 20037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatttacttagggagtgtcgcttccccgt

SEQ ID NO: 20038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaatttcgtttgttgccgtagtctcccgag

SEQ ID NO: 20039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaaagcccctgcagtgtggcgaatcggt

SEQ ID NO: 20040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaacaacatcggggcaccttccgctggc

SEQ ID NO: 20041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaacagctagtgcgggctgggtagccgg

SEQ ID NO: 20042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaactgcacttttattgaccgtatagtc

SEQ ID NO: 20043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaagcgatttcgttcagtaggttcgggc

SEQ ID NO: 20044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaaggcaactttatggatcgcgatgaga

SEQ ID NO: 20045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaataattcgcgaattgcaggaattgtc

SEQ ID NO: 20046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaatctgattcgactgctcactggacac

SEQ ID NO: 20047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacacatccaacagcaatcaacgctcgt

SEQ ID NO: 20048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacagccacttgcgagcgacgccgtggt

SEQ ID NO: 20049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaccattattcatagacttttcagcttc

SEQ ID NO: 20050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacccggcggcacacttaggggtgtgac

SEQ ID NO: 20051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacgctcatccacggcttcacgtaccca

SEQ ID NO: 20052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacgttttcgccatgccacgttaatgga

SEQ ID NO: 20053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacactcccagcttatgttccacagtgaag

SEQ ID NO: 20054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacactcttccagtttatgcaggtgcggct

SEQ ID NO: 20055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacactgttggatacgactaaacaggtatt

SEQ ID NO: 20056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacacttatatggtactactagatgagcgc

SEQ ID NO: 20057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacagattcagcaaagttgagtgtctcacg

SEQ ID NO: 20058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacagcacggtgtaatgccacttcctgtac

SEQ ID NO: 20059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaggatgcgacgtttgataggccagtgc

SEQ ID NO: 20060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaggcatgcggcttgtcaaacgagcgag

SEQ ID NO: 20061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaggcttcagtatcccatacttgcgggc

SEQ ID NO: 20062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacaggtaggggttgaaattaagacggcgg

SEQ ID NO: 20063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacagttgtccacttctctcaacattccac

SEQ ID NO: 20064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacatacgggacaacggtgttgaatcttcc

SEQ ID NO: 20065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacatcgacatatcttagatcttgtctatg

SEQ ID NO: 20066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacatgagaacacacagttcgtgttgtagg

SEQ ID NO: 20067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacatgcatctgctggcctgtaatgatgta

SEQ ID NO: 20068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacatgccacgccctccaccaaggcgatcc

SEQ ID NO: 20069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacattcatggtagtttcgccaagtactgg

SEQ ID NO: 20070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacattgcatccgtgtacacttccacaatc

SEQ ID NO: 20071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccaatcgcttcacttggcaatgccatct

SEQ ID NO: 20072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccacatgctatcgcctcgacacagcgca

SEQ ID NO: 20073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccacgaatatacccgacaattttgagga

SEQ ID NO: 20074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccactgttcagccgactccactttgggt

SEQ ID NO: 20075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccacttggacatacggcaggggagcaca

SEQ ID NO: 20076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccagcgtcacggaagaatgtctcatgac

SEQ ID NO: 20077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccatagcaacggccgaacctcccctccc

SEQ ID NO: 20078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccatatccgatataagctcaggtcggtg

SEQ ID NO: 20079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacccgagatcgggaagagacttgcccccg

SEQ ID NO: 20080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacccgagcataatcctactgccgtgaggg

SEQ ID NO: 20081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccctgccgaaacgtactcgtactgcgga

SEQ ID NO: 20082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacccttacgcgttgcaggccggttcacgg

SEQ ID NO: 20083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgagctggggacagtaacacgctacat

SEQ ID NO: 20084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgccagattcggctgtgtggtttgccg

SEQ ID NO: 20085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgcgtagaatgtgtggaacgcccagta

SEQ ID NO: 20086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgggaaattttgttacgtcccgggtca

SEQ ID NO: 20087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccggggcatgcggattggcataccatag

SEQ ID NO: 20088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccggttaccgctttcttagctctttggc

SEQ ID NO: 20089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccggttcaggcattgccgggcatccggg

SEQ ID NO: 20090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgtccgagtcctaggaacactatcgcg

SEQ ID NO: 20091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaccgttacacattagcgtagcttgcacgg

SEQ ID NO: 20092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacctcgcacgtgcccgcactcgaacatgt

SEQ ID NO: 20093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacctgacctgcgagatacggggtagctac

SEQ ID NO: 20094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgacgaccgtcacagatccgcccccttg

SEQ ID NO: 20095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgacggaattttgcctcgcccgggatgc

SEQ ID NO: 20096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgacggtgtaacggagcctgcgactcct

SEQ ID NO: 20097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgactggggatgagtcagcaatgccttt

SEQ ID NO: 20098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgagatttgcccggcaaaggctgtgttc

SEQ ID NO: 20099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgaggcgtacccaatcggttgacgggtt

SEQ ID NO: 20100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgatcgaggagaggcgaagtgtgtgatc

SEQ ID NO: 20101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgatcggcatttaaccacatcattcgtt

SEQ ID NO: 20102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgcccgtgccattccatcatacggtaca

SEQ ID NO: 20103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgccgcaagtgtaatccgcgtactaatc

SEQ ID NO: 20104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgctacggcaagcacccgaaggccgcga

SEQ ID NO: 20105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgctgcctagtccttttacattcgacgt

SEQ ID NO: 20106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgggagggtacatatctcgcgtttgcgc

SEQ ID NO: 20107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacggggatcgcaactgctgggcatcagta

SEQ ID NO: 20108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacggtcttcttatctagtaaaattcactc

SEQ ID NO: 20109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacggtgtcggtgaggacccccggccactc

SEQ ID NO: 20110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacggttcggccatgtccacgagtgagcat

SEQ ID NO: 20111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgtacgcggtagaagcggacaataaacg

SEQ ID NO: 20112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgtccttgaacgggtataaagcaccaat

SEQ ID NO: 20113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgtcgtgctcttccttaccttgaccggc

SEQ ID NO: 20114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgtgctaaggagaacagtaccgatttaa

SEQ ID NO: 20115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgttccacccctggcaatcgtgtttgat

SEQ ID NO: 20116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgttcctaccacttgttctagtataggc

SEQ ID NO: 20117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgttgttttgagggaggaggtacgcgca

SEQ ID NO: 20118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgtttcagagtagaccatcccatatctg

SEQ ID NO: 20119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacgttttgtgagagatgctgggttctgat

SEQ ID NO: 20120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactacacatgcaaggccacgtccaaatcg

SEQ ID NO: 20121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactaccctaaatcatcctcaactagtcaa

SEQ ID NO: 20122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactactcgttagccgtcgggaggcgtcgt

SEQ ID NO: 20123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactagtacgccaagtattctgttgcaggt

SEQ ID NO: 20124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactatactggcaggaaaacagtatacgga

SEQ ID NO: 20125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactcaggattcttacaatgccatgcctat

SEQ ID NO: 20126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactccaagtctaaatgaccggccgtgcgg

SEQ ID NO: 20127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactcccagttccgacctcaacttcgcccg

SEQ ID NO: 20128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactcctcccaagtcatgcgagctctttta

SEQ ID NO: 20129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactcgagattttgatgcccttgtaatttt

SEQ ID NO: 20130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactcgtacttaatgactacggggaaggga

SEQ ID NO: 20131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactgagttactttcaggtattgattgata

SEQ ID NO: 20132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactgcgccggactgggaggtgaaatcacc

SEQ ID NO: 20133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactggtaggacgcctttccttgccgggga

SEQ ID NO: 20134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactggtatcccatcacgctggtagacgga

SEQ ID NO: 20135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccactgtcccgccgcggttgttcgttggttt

SEQ ID NO: 20136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacttatatcaggcgggaagcaggatgcga

SEQ ID NO: 20137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacttcattgggtacgcgctgactgattga

SEQ ID NO: 20138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacttcgcgaggcagtttgcgacggccaac

SEQ ID NO: 20139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacttgcactgctcaatagtcccggcccgt

SEQ ID NO: 20140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccacttgtggcaatggagaatcatgacttgt

SEQ ID NO: 20141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaaccgtgacggtcatcccatgccctgt

SEQ ID NO: 20142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaactgcgtcgatccatgactgaagccg

SEQ ID NO: 20143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaaggaagtctcctgagataaggccccg

SEQ ID NO: 20144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaatttttctatcttgttacgattttca

SEQ ID NO: 20145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacaaggacttggatttggacgagggaa

SEQ ID NO: 20146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacacgagtgacaccttgtctgtcgacc

SEQ ID NO: 20147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacatcgtgttgtgtctccgtacctggc

SEQ ID NO: 20148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaccacgtgcttgccgttcagacaggcg

SEQ ID NO: 20149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaccctagcatgtgttcgtccgccgtcg

SEQ ID NO: 20150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacgaagattgtgctcccgatgaaatgg

SEQ ID NO: 20151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacgattgacaaggctcagcgtgacgtt

SEQ ID NO: 20152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacgccaacctggataactagcccgccg

SEQ ID NO: 20153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacgcccttctctcgagctatttggacc

SEQ ID NO: 20154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagacgggtattcagatctggcacaatccc

SEQ ID NO: 20155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagactcctaccctcaccttttatgtacgc

SEQ ID NO: 20156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagaggggagcgctaggactcacaccat

SEQ ID NO: 20157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagcaacgggttgtagccggcatccgtg

SEQ ID NO: 20158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagcagaccccatgacgtgcgcactagg

SEQ ID NO: 20159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagcgaaatccggatgggaggtcccgac

SEQ ID NO: 20160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagcttctatagtcgctgacgtgggtac

SEQ ID NO: 20161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaggactaaccttcaggcgtctgtaggc

SEQ ID NO: 20162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaggcagcttactggactgggggtcaag

SEQ ID NO: 20163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagaggggcgtcgtctgtcttatgtgttgg

SEQ ID NO: 20164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagtcatggcaaataagcgcacgttgct

SEQ ID NO: 20165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagagtcgcgtgtgcttctaggacatctcc

SEQ ID NO: 20166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagatacacgttggaccgttacaggatggc

SEQ ID NO: 20167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagatcatgaccgcactaccgccatcggtt

SEQ ID NO: 20168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagatcattgtgccaggacaatgtggtgga

SEQ ID NO: 20169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagatgagaattatgattgcaccgttatgt

SEQ ID NO: 20170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagattccggtatgccatctcctggaaatg

SEQ ID NO: 20171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagatttactcatccaatatcacggcttgc

SEQ ID NO: 20172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcaactataagcacggctgcacgctcac

SEQ ID NO: 20173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcaataaggggcgtgtatagctcggggg

SEQ ID NO: 20174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcacccagttcgtggactgtgttgtccg

SEQ ID NO: 20175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcacctagccagttgtgacatacgggtc

SEQ ID NO: 20176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcacggaagatgtcttactcgggtagtc

SEQ ID NO: 20177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcacgtcaacgtcattggttaggaggaa

SEQ ID NO: 20178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcacgttcattcaagctcagttagcaag

SEQ ID NO: 20179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcagaaccgagagctgtgtccatggcgc

SEQ ID NO: 20180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcagtgcttcatcatcatcggatgcagg

SEQ ID NO: 20181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcagttcggccttagttgactaggcgga

SEQ ID NO: 20182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcatcacgcactttcgagacactgcgcc

SEQ ID NO: 20183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcatgtatgacacaacgtccgacgcctc

SEQ ID NO: 20184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagccattggtcgcctgattcccgggtctg

SEQ ID NO: 20185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagccgtgcatctacgttgaataggttctt

SEQ ID NO: 20186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgatttatttctattcaattggcagcg

SEQ ID NO: 20187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgctaacctggctttcttgtgacattc

SEQ ID NO: 20188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgctgcctgccgtgtacactgtagccc

SEQ ID NO: 20189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcggggttagaccgggctacatccgcgc

SEQ ID NO: 20190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgtcgggagggcactttgtacgcttgg

SEQ ID NO: 20191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgtcttgctcctgttctgtcgatatga

SEQ ID NO: 20192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgtgattgcaccgcttccccggcatca

SEQ ID NO: 20193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagcgttgagcagggacatccgaaaaccgg

SEQ ID NO: 20194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagctacagagcaaggaccactatccacaa

SEQ ID NO: 20195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagctccgatattcactgtttaggctggtg

SEQ ID NO: 20196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagctggcacgacggtctgtgaattcacaa

SEQ ID NO: 20197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagctgtctggagcgttgtccgagtcaaaa

SEQ ID NO: 20198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggaacagcggccttatacgcggagtggg

SEQ ID NO: 20199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggaatccttacacgtcctaacctaagtt

SEQ ID NO: 20200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggacttcagtcggttgtcaggggatgac

SEQ ID NO: 20201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggagtagaaccgatcaagcacatgattc

SEQ ID NO: 20202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggatacggtaggggggcggttgttgctg

SEQ ID NO: 20203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggatcgggtagtagtcattggcggcgat

SEQ ID NO: 20204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggatgggtcggcagctccccagttgttg

SEQ ID NO: 20205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggatgtcacgtctgcgtgtgagtccagc

SEQ ID NO: 20206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggatttggacgcgtagataacgggtttt

SEQ ID NO: 20207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcaacccctatcggctggtaagggccg

SEQ ID NO: 20208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcacatgtccctgcactgaaaatacgc

SEQ ID NO: 20209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcacctgagtacaggctgtcggagagg

SEQ ID NO: 20210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcagcctcaatggttccgcggtgttcc

SEQ ID NO: 20211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcattacgactatcgtatcccgcttgt

SEQ ID NO: 20212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggccccaggtgtgtcgttaagatacctc

SEQ ID NO: 20213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcgaataaactgttcggaacttatggg

SEQ ID NO: 20214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcgcacattttgttggtaagggtttac

SEQ ID NO: 20215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggcggtgatattggtctccattttcatg

SEQ ID NO: 20216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggctacctattatggggaaccagtgcca

SEQ ID NO: 20217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggctgaccagcgctaggtcgacctaagc

SEQ ID NO: 20218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagggaatatgtatgggggcgctgtaagga

SEQ ID NO: 20219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagggacatgtatactgaatccgcgtggct

SEQ ID NO: 20220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagggagggaggcgccgacactcgattgtc

SEQ ID NO: 20221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagggatgcgaaagaggcttctaactagcg

SEQ ID NO: 20222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtaataacgcctcataagtcgcaacgg

SEQ ID NO: 20223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtacgtcatgcgtaattgcgggcgatc

SEQ ID NO: 20224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtatagccccggtctgggtggcgcaag

SEQ ID NO: 20225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtatttgttggtgatgaggcccagggt

SEQ ID NO: 20226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtcacacagtcccattgtggcgaccaa

SEQ ID NO: 20227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtcgccggtgcaatttggggttgtgtc

SEQ ID NO: 20228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtggagcggagacagtttatattcctt

SEQ ID NO: 20229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggtgtctatcgtaatcgacgggcggtaa

SEQ ID NO: 20230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggttactctagggtggccacgccaattc

SEQ ID NO: 20231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccaggttatgcagcatttggattccgctagc

SEQ ID NO: 20232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtaaagctgccagtgctgacctgacgct

SEQ ID NO: 20233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtaattggctgtttccggcgttacccgc

SEQ ID NO: 20234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtacaattagtgtatgcttttatctgta

SEQ ID NO: 20235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtatattatcctgtgctccttcgcgtgt

SEQ ID NO: 20236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtatgattccgtatgattacaggcggcc

SEQ ID NO: 20237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtcattcgatttggacccgcgcttgtgc

SEQ ID NO: 20238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtcctccttgaaatgcgagaggtactcg

SEQ ID NO: 20239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtctctcaccttccgtcggtacaggcgg

SEQ ID NO: 20240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgaaggccgcgcgtttgccctatgctc

SEQ ID NO: 20241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgcacgacaaagcatgacccgtgaatc

SEQ ID NO: 20242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgcatacagtctgacaaacgggcccgt

SEQ ID NO: 20243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgcggtcgactgagaacaccggtccgg

SEQ ID NO: 20244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtggccactagttggtgcaactttttta

SEQ ID NO: 20245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtggcgactatagccggcttcgtggcgc

SEQ ID NO: 20246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgtcattccacatgttcccttatttgt

SEQ ID NO: 20247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtgttcgggcacgtctgtctggtaccgg

SEQ ID NO: 20248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttatgaatcagctgtgatgcgttcctc

SEQ ID NO: 20249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttcaaattgtaaggggaaaggtttata

SEQ ID NO: 20250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttcgtcgctcggtggtgttattggttc

SEQ ID NO: 20251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttctctttaggttgggggtgagaagga

SEQ ID NO: 20252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttgcggcggcttggggcgaacaatatc

SEQ ID NO: 20253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagttgtggatgcacctgtgaccttgcgga

SEQ ID NO: 20254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtttgcggattgtatgaaccggggtgac

SEQ ID NO: 20255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccagtttttgcgattcatttcccgggggagc

SEQ ID NO: 20256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataacaggactttgctctagctcgcctga

SEQ ID NO: 20257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataacctaatactcttaaatcgtctttct

SEQ ID NO: 20258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataacggagtctcgtctcgcatcgttgtg

SEQ ID NO: 20259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataactcgcggggtagggtctacgtgggc

SEQ ID NO: 20260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataactctagacccctacccatttatagc

SEQ ID NO: 20261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatacagtgggtagcgtaacgctggccgtt

SEQ ID NO: 20262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatacatcccagctcaatgcggtggtggcg

SEQ ID NO: 20263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatacctaggtgagaaaggaccgtcgcttt

SEQ ID NO: 20264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatacgtctatgtggggcacttgtccgcgg

SEQ ID NO: 20265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatactctttatacgggaatgttaatcgtg

SEQ ID NO: 20266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatactttagtcagtggctgaatcacaaat

SEQ ID NO: 20267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatagcgttctgtcgccttggcttggtggt

SEQ ID NO: 20268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataggacacagccagcaatactgatggat

SEQ ID NO: 20269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataggatgaaaagtgtaatatgtatggtt

SEQ ID NO: 20270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccataggcgcagcagtttatatgtgaccgcg

SEQ ID NO: 20271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatatattcacctacctaaatgatacggtg

SEQ ID NO: 20272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatatgtatcggttggcacacaaacggttc

SEQ ID NO: 20273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcaacatctcacaagagtgcatgttctc

SEQ ID NO: 20274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcaaccacgatgtgtacgtgcggatcga

SEQ ID NO: 20275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcacagctagcattccttccttccgggg

SEQ ID NO: 20276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcactattagtatctgggtgggttgacc

SEQ ID NO: 20277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcagctagagtgccttgattggtattta

SEQ ID NO: 20278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccacccgtcagtgtgcttgttgtcgcg

SEQ ID NO: 20279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccacgttgaaggcaatctaggtctctc

SEQ ID NO: 20280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccctgcacagttggttgtccggtatga

SEQ ID NO: 20281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccgaaggcgcaggtttagtatggcgcg

SEQ ID NO: 20282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccggcagccaagctacacgaggtttgc

SEQ ID NO: 20283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcctagcatcagtcacttcctaaccact

SEQ ID NO: 20284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcctgggcacgcacacaggggcgtagtc

SEQ ID NO: 20285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatccttgcaagatgtttgacactttggta

SEQ ID NO: 20286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcctttcgcggtcccttttggctgcgtg

SEQ ID NO: 20287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgagccgggcgatggacggacgcagtg

SEQ ID NO: 20288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgatctaaccagaggaggcccgcgctt

SEQ ID NO: 20289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgcacaacaagaactatacgcggggcg

SEQ ID NO: 20290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgcttcgatagccccagcgggtggtag

SEQ ID NO: 20291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgggcaaagacccattgcagaagcgcc

SEQ ID NO: 20292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgtcacccggcatgttatctatccgct

SEQ ID NO: 20293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgttagcttattggcactttgcgggac

SEQ ID NO: 20294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgttgttgagctcccacgcttttactc

SEQ ID NO: 20295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcgtttgtgttaccggatcagtagcacg

SEQ ID NO: 20296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatctagcacgaaacgacttagtcgtaaga

SEQ ID NO: 20297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcttatgccgtatccgattaaaaaatta

SEQ ID NO: 20298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcttccacgacccaactaatagccgctc

SEQ ID NO: 20299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatcttggccagtggacggttgcgtctgcg

SEQ ID NO: 20300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatctttaacagaggaagttcaaacacccg

SEQ ID NO: 20301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatctttgctggtaccctcctggaaatacg

SEQ ID NO: 20302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgaacgcattggttgtgggagtttcgca

SEQ ID NO: 20303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgaagcattgcgggtcttacatatcggc

SEQ ID NO: 20304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgacatccgggcttcgataacaggggac

SEQ ID NO: 20305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgacgcacctagcaattccgggtctgtg

SEQ ID NO: 20306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgagtgtagatggtagtaagttgcgatg

SEQ ID NO: 20307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgatctgacctaagttgttgtctccgcg

SEQ ID NO: 20308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgcacgccgctttggtatttggatgtcg

SEQ ID NO: 20309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgcaggcaattttgctccgcagcggttg

SEQ ID NO: 20310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgccaaaatcgggcacggaggacgtggt

SEQ ID NO: 20311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgcgattagttccaacagctgagataat

SEQ ID NO: 20312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgctccgaccctcgaactccattcgtgc

SEQ ID NO: 20313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgcttcccccccttttggtgattggatt

SEQ ID NO: 20314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgctttcgatgccgcgtcataccgtcgt

SEQ ID NO: 20315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggactcatgcgctactacacactcgcg

SEQ ID NO: 20316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggcgttgtaccaaagatttgcgtccca

SEQ ID NO: 20317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggggcaacctgccgggggtccgctgcg

SEQ ID NO: 20318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgggtcatacggtgccgcgtgataatgc

SEQ ID NO: 20319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggtcgactcttagttgcgagtgctgtg

SEQ ID NO: 20320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggtcgagggagcgccatccgtctatac

SEQ ID NO: 20321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatggttgacctcgctcctcggctgaaaag

SEQ ID NO: 20322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtaagttggttggtgtgtcgctcatcg

SEQ ID NO: 20323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtattttagggggggcttaatcttcgg

SEQ ID NO: 20324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtcaggccaccgcttggtaagctcgtc

SEQ ID NO: 20325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtgagacttcagacatgtaccgagtgg

SEQ ID NO: 20326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtgcatatgcgtaagggaggggtcttc

SEQ ID NO: 20327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgtgcggagatgcggctctttgcgtgta

SEQ ID NO: 20328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatgttacgcattcgcagtttatcccatac

SEQ ID NO: 20329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattaacgagcgtcttgaccgtgcggttgg

SEQ ID NO: 20330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattacagtcaagtcttacgtccgctgggc

SEQ ID NO: 20331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattagcagtgatgcaatacttcccctccg

SEQ ID NO: 20332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattaggcaccgactctgcgcttctggact

SEQ ID NO: 20333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattagttagatattacgtggagtagtgtg

SEQ ID NO: 20334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattatcagcctgctgcggcattacctttg

SEQ ID NO: 20335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattatcatacgagaccctttcgcacgatc

SEQ ID NO: 20336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattcaatgccgtaaacgaagcccatggtc

SEQ ID NO: 20337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattcagatccttttcctcgagggtgcggc

SEQ ID NO: 20338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattcatgccttgctctactggctctaggc

SEQ ID NO: 20339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattccttcagacatgcactgcgctagttc

SEQ ID NO: 20340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattcgtaaaaggagaatagccgcgttctg

SEQ ID NO: 20341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattctcgaagaggtttactaatctccgcc

SEQ ID NO: 20342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattctttccggctcgatgcacctctcgtg

SEQ ID NO: 20343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgaatatgtttctcgttccggggcaca

SEQ ID NO: 20344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgaatgtaagttagttgtaccacatta

SEQ ID NO: 20345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgacagcatgccttaaagtggtaggcc

SEQ ID NO: 20346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgcgcagataggctatttctaccaggt

SEQ ID NO: 20347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgcgcccacactcgagcgttcgtggaa

SEQ ID NO: 20348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattggccgggaggtgtcggttatggctag

SEQ ID NO: 20349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattggtgtgtagcgatggcaacagtgttc

SEQ ID NO: 20350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgtaggaggggggcgttagcttgtaac

SEQ ID NO: 20351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattgtcgagggggcgaacgcgtacatttg

SEQ ID NO: 20352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatttaaatggcaggtcctgttttgattca

SEQ ID NO: 20353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatttcttagtgtcgcttctcgagtggttg

SEQ ID NO: 20354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccatttggatataggcaactttagccgacga

SEQ ID NO: 20355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattttacgccgatcttaggagggttttgc

SEQ ID NO: 20356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccattttgatcttagtgtccctatccggcgt

SEQ ID NO: 20357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaaccccaggcccatgggggtcttgtac

SEQ ID NO: 20358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaatgaccgacccttgcccgacacaagc

SEQ ID NO: 20359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaacaccagcgcatgagtccgtgaaatgc

SEQ ID NO: 20360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaacagaaggtatgcgaacaaaaggccga

SEQ ID NO: 20361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaacccggcgctgtatccttatcgcgtgc

SEQ ID NO: 20362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaccgaccgggagtgtaatactaccctc

SEQ ID NO: 20363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaccgcactttacagaggtactggagta

SEQ ID NO: 20364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaccttctgaacagcggacggcaaactc

SEQ ID NO: 20365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaacggtgttgtagatagtataggcctgt

SEQ ID NO: 20366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaactcttgccactgactcatttggagta

SEQ ID NO: 20367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaactttcggattatctacgtctgcgagc

SEQ ID NO: 20368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaagcgagtgcgtaccggtttcgggttca

SEQ ID NO: 20369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaaggcgctggtcatccccgtgatcgtga

SEQ ID NO: 20370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaatcaggctgatcagacaaaactgatgc

SEQ ID NO: 20371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaatcgacttttccccccgacatagtacg

SEQ ID NO: 20372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaatcgtcatgcgcggttatgttacggtt

SEQ ID NO: 20373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaatctaaacactggctctagccttgcgg

SEQ ID NO: 20374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaatgacggcaagtcacgatttcggagtg

SEQ ID NO: 20375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacaccgaatgaggttcctcagggatacg

SEQ ID NO: 20376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacacctacagggtttcgttcgcggtatt

SEQ ID NO: 20377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacagccatcctgaccttatggttgctag

SEQ ID NO: 20378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacagtgtatgacattttgtgttgcctcg

SEQ ID NO: 20379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacataggatcaagtaaaggcgcctcgtt

SEQ ID NO: 20380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacatgactcggacgcatcctgtttggtt

SEQ ID NO: 20381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacattacagccacaacacgaatgtttgg

SEQ ID NO: 20382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccaagcgtatgcacgtttgatagggtg

SEQ ID NO: 20383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccaaggtaaatggccctcgtcgtcgag

SEQ ID NO: 20384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccactttccgtcgcgttcgcaccgcta

SEQ ID NO: 20385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccccggtaggcaatcttagcgagtttg

SEQ ID NO: 20386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccgccatcggctccgtgccataggccg

SEQ ID NO: 20387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaccgctcggcgccgctctggtcacgtct

SEQ ID NO: 20388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacctggaccatgaaggattttgcctgcg

SEQ ID NO: 20389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgctgagttacgtgtttttgtagcacg

SEQ ID NO: 20390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgcttcgaatacgcggccgtacgctgt

SEQ ID NO: 20391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgctttggttcgtcgcttaccgggtac

SEQ ID NO: 20392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacggattcaagatgtcggtggacggtgc

SEQ ID NO: 20393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtccaaccggtcgcccttgcactctc

SEQ ID NO: 20394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtcggccaacccggacgaaactctat

SEQ ID NO: 20395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtcggcgtccaaccagtgtaggccat

SEQ ID NO: 20396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtggacacttcgctacatgcggttgt

SEQ ID NO: 20397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtggtggatttggctgggtcggaggg

SEQ ID NO: 20398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgttgggaacggagcgagctgcgtgct

SEQ ID NO: 20399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccacgtttatacatatgccagggaatgacg

SEQ ID NO: 20400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactaatttggatttttaatgagttgtca

SEQ ID NO: 20401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactcaattccatagccccatatgtgtcc

SEQ ID NO: 20402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactcgaacctgaatctgattgatttgag

SEQ ID NO: 20403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactctggaattggtcgctgcgctcagag

SEQ ID NO: 20404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactgagctcggtgctcccgggtaagggc

SEQ ID NO: 20405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactgctcgtgaggaatgggttacttcac

SEQ ID NO: 20406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactgtccattcggccggtacgcttatga

SEQ ID NO: 20407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccactttacttatgatgaggcttgcgccta

SEQ ID NO: 20408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagacaaacgcttgttcgtatcgcgcgga

SEQ ID NO: 20409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagacttaattcgacgaacggtctcggaa

SEQ ID NO: 20410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagagagggctccgagttaacagtacggg

SEQ ID NO: 20411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagataggacgggaatctgcccaatcctg

SEQ ID NO: 20412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagatctcccggaaactacgccgccgacg

SEQ ID NO: 20413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagatgtagaacatggccgacagctgtct

SEQ ID NO: 20414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcaacgcatggtacacgagcaccactt

SEQ ID NO: 20415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcaactgttttctgccacgccgcgatc

SEQ ID NO: 20416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcacacgaggattcaatgcgcgttcgc

SEQ ID NO: 20417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagccgacccttgacgcaggtgacccggt

SEQ ID NO: 20418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcgaatgagagcaccgatgtcattagt

SEQ ID NO: 20419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcgcttctgcctcggtgtttcatgttc

SEQ ID NO: 20420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcgtggactttgcactacgcgagctcc

SEQ ID NO: 20421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagcgtgtggtcgcatacgtgggattgat

SEQ ID NO: 20422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagctacatttcaatcggtttgggacgac

SEQ ID NO: 20423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagctatgccaccctccttgtggattagc

SEQ ID NO: 20424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagctcgcacataaggttcgcactagtcg

SEQ ID NO: 20425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagctgatattctatcacccgcgtttttg

SEQ ID NO: 20426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaggacagaggcagcggaggtttagagca

SEQ ID NO: 20427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagggtatgggcccgccttccgcatccgc

SEQ ID NO: 20428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagggtgatgccgcacggttaatctgtct

SEQ ID NO: 20429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaggtcatttgcctaacatatgaacagga

SEQ ID NO: 20430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccaggtcccgctctaagttagaatctggat

SEQ ID NO: 20431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtagttgttgccctgtacggcgaattg

SEQ ID NO: 20432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtcgggacgtgaggttgtgcacggtgg

SEQ ID NO: 20433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtgcaaaattggggggtcacactccca

SEQ ID NO: 20434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtgctcgcttaaggcgccggtaacacc

SEQ ID NO: 20435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtggatggttggctactggcgttttct

SEQ ID NO: 20436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccagtgtggcaccgtaaagctgtgaagggg

SEQ ID NO: 20437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccataacttgacgcgctgggggatccatgc

SEQ ID NO: 20438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatacaatggttagcttaggacgtctgtt

SEQ ID NO: 20439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatacacacttgcaattggcgctgcgctg

SEQ ID NO: 20440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatcagacaagacaccgttgcgatgatgc

SEQ ID NO: 20441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatcctggagtaatacaaaccagttaggc

SEQ ID NO: 20442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatctctttgacgctcctggtgagcttag

SEQ ID NO: 20443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatgcccaggttgggtgttaagcgccgac

SEQ ID NO: 20444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatgcctcattcggagagacccgtcccgc

SEQ ID NO: 20445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccatgtgcactattgccgcactcggttacg

SEQ ID NO: 20446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccattaaacagagccggactgttattaaag

SEQ ID NO: 20447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccattaacctcgagtggaactttctggtag

SEQ ID NO: 20448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccattcacgagggcaagatcctgacggccc

SEQ ID NO: 20449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccattcgacgttttaccttatgcgctcaaa

SEQ ID NO: 20450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccattctgtgcatcgtccaaacgtctagtc

SEQ ID NO: 20451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaacgtgatgcgcgggacaacattgcga

SEQ ID NO: 20452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaactcgtatcaaacggacgttcggttg

SEQ ID NO: 20453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaagattggacccaagccctggttccgt

SEQ ID NO: 20454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaatgcagtgccaaagaccgacggtttc

SEQ ID NO: 20455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaattgcctagccaatcccgctcctcct

SEQ ID NO: 20456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccacaacatcggcttgaaccgcggtggca

SEQ ID NO: 20457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccacaacgtcaatcgtgtccgcttttcac

SEQ ID NO: 20458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccacagtgccgcaacttgaccagcatatc

SEQ ID NO: 20459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccacgctgctgtattcttacatagatagt

SEQ ID NO: 20460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccactacctctacatgcatcgtcccttta

SEQ ID NO: 20461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccactagcaatttggtcggctgacgtaaa

SEQ ID NO: 20462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccagaagccactagaagtcaacggcggcg

SEQ ID NO: 20463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccagatagggaactaagtgccattacgta

SEQ ID NO: 20464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccaggcattcaggggaactctggctagac

SEQ ID NO: 20465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccagtatgcgagttcagctgcagtgtaac

SEQ ID NO: 20466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccagttggtctagtggtacatccgccgcc

SEQ ID NO: 20467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccatcaagatagcttacgtgcgtttgtgc

SEQ ID NO: 20468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccatccgacctgaggaaagttaagctctc

SEQ ID NO: 20469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccatcggtttattttttgtcccttcgcgt

SEQ ID NO: 20470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccatgagaccgagcttgtgtattgtccgg

SEQ ID NO: 20471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccacgttctgcttattcagtttgatttg

SEQ ID NO: 20472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccaggtaggttgctcgtgctaatctgcg

SEQ ID NO: 20473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccatgcaggcagctgatccgtatgtgcc

SEQ ID NO: 20474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccatgcttgggaagtctttagcggtccg

SEQ ID NO: 20475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccacaacgctggttcgcagactagctg

SEQ ID NO: 20476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccagcgcagtcggtaaccgtggaaact

SEQ ID NO: 20477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccagtaaattactgtgtgcgtaacgtt

SEQ ID NO: 20478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccatcacttgatctctcgttcctttgt

SEQ ID NO: 20479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccccggcttataaaagcgaagtaacgtg

SEQ ID NO: 20480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccccttccgaatagtcagtacagccgaa

SEQ ID NO: 20481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccgtgtaccagtgtggtcaaggtagtg

SEQ ID NO: 20482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccgtttgaccgaggacaactgacggtt

SEQ ID NO: 20483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccccttgtttgagtttggtggatactact

SEQ ID NO: 20484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgaggttctcacttactacagatgcgg

SEQ ID NO: 20485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgattcccattcacgtcgactgtgcaa

SEQ ID NO: 20486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgcattgaccgactccgtatactcgaa

SEQ ID NO: 20487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgcccgcactcgattaacccgcgtgac

SEQ ID NO: 20488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgcgctcaagtgtggtcactgcagctg

SEQ ID NO: 20489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgctcctatccagttaacccactatcg

SEQ ID NO: 20490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccggcgcagtaaaacgatgccgaactct

SEQ ID NO: 20491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgtatagatgccacttgatcctttgcg

SEQ ID NO: 20492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgtcccctgcaacggtttacagagcgt

SEQ ID NO: 20493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgtccctagcaacggtttacagagcgt

SEQ ID NO: 20494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccgtcgatttagttcccgtcgatgctac

SEQ ID NO: 20495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccctattctacttataagggaccgttgta

SEQ ID NO: 20496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccctcaacgaccatcgacgcaatagttat

SEQ ID NO: 20497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccctcggtcatctgttctcgagcaacatc

SEQ ID NO: 20498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccctggacacctgcaggagtctccacgtc

SEQ ID NO: 20499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccccttagactcgataaaagccaacagata

SEQ ID NO: 20500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgaacgcaggtaatgcgagcagactatg

SEQ ID NO: 20501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgaagaagcgcactgatatatgccggcg

SEQ ID NO: 20502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgaagcagttcgcgtttatgggcctttc

SEQ ID NO: 20503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgagtgaacgcagctcgatagttcgctg

SEQ ID NO: 20504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgatcgcacgaagctaacaccgatgttc

SEQ ID NO: 20505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgatgcgaggccaggcacaatcggctgc

SEQ ID NO: 20506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgcactcttctccgtaaccgtgagtaat

SEQ ID NO: 20507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgccgccatgaatcgatcgggccgtgct

SEQ ID NO: 20508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgcctctacaagaggtatgaactgaagg

SEQ ID NO: 20509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgcggcatagacgcacttggcatctagt

SEQ ID NO: 20510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgctccgcgcgctaggctaccgagctgt

SEQ ID NO: 20511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgctctcgagtgggaagacgcggatatc

SEQ ID NO: 20512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgctgggacacgtcttgggactcatgca

SEQ ID NO: 20513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggagaactagctcgagtttgctcgggt

SEQ ID NO: 20514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggatctcctgcacgtcccccgccattc

SEQ ID NO: 20515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggccatcgccgttctgcgtttagacga

SEQ ID NO: 20516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggctttcggcagcgcgcaggtgttcac

SEQ ID NO: 20517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggtcgacacttgcacgggttaaacgtt

SEQ ID NO: 20518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggtcgacgtgctgggtaccgtggtaac

SEQ ID NO: 20519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccggtgttaagatttacgtctgtggactg

SEQ ID NO: 20520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgtattggcttgttattcagcgactggt

SEQ ID NO: 20521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgtcgctacacagttgagattccgtgcg

SEQ ID NO: 20522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgtggattttgtctccctggtgcgtccg

SEQ ID NO: 20523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgtggtttaaattcacgcgccaatcgtt

SEQ ID NO: 20524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgtgtcactgtcatggccgttgttcagg

SEQ ID NO: 20525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccgttactgagaccactgcttgatcaatc

SEQ ID NO: 20526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctacgaaaaccatcgacatcgcatggtc

SEQ ID NO: 20527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctatactgacgctgtcctatgttgtgca

SEQ ID NO: 20528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctcacgatttcccaagtctgaaaagggt

SEQ ID NO: 20529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctccctgtgggcatcggcaataaagtgc

SEQ ID NO: 20530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctcctaaacgtgaaagtgtccgtcgttg

SEQ ID NO: 20531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctcgaggacaaacgcaattccgtgggcg

SEQ ID NO: 20532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctctctcgcttcttcttcactacttgtt

SEQ ID NO: 20533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctctgcacctttggagtacgtcgtggtg

SEQ ID NO: 20534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctcttcagatggtgacaagtttgcggac

SEQ ID NO: 20535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctgatagatcgggatcactcacttgggt

SEQ ID NO: 20536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctgcaccgtgcccagttcgtctgttgtg

SEQ ID NO: 20537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctgccgccggttttgtgcgtatgctttt

SEQ ID NO: 20538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctggtatggcataagggttgcgactata

SEQ ID NO: 20539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccctgtccggatggcaacaactcgagtttg

SEQ ID NO: 20540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccttcatctctaaggagttgtatcgtcac

SEQ ID NO: 20541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccttcgacaatttttgccttcgcaacttg

SEQ ID NO: 20542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccttcgacagtggattcgaggattgggcg

SEQ ID NO: 20543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccttgatgtagtgtcgtttgacaatttgg

SEQ ID NO: 20544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccccttggtaggacggtcgaaagatgtcacc

SEQ ID NO: 20545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaacgagtaactccggcagcaccgagtg

SEQ ID NO: 20546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaagaaaaataaagagctgctctcgagc

SEQ ID NO: 20547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaagatgcctgaggtgaccgtgcgttga

SEQ ID NO: 20548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaagcgctggtgtgtcttctttgccttt

SEQ ID NO: 20549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaagcgtgcaacagccaagctccccgcg

SEQ ID NO: 20550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaagttgggtgaatttaggtgcggcggc

SEQ ID NO: 20551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaatatgagcgagtcaatcggctgcgct

SEQ ID NO: 20552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaatcgatcgaatgttggagcgctcgcg

SEQ ID NO: 20553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaatcttagcccaacgtttcacttcgtt

SEQ ID NO: 20554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaatgcactagaggaaacggatcgtccc

SEQ ID NO: 20555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaccatgccgccgctcccgtatgtccgt

SEQ ID NO: 20556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaccgcctgagcgaggacgagcatttgt

SEQ ID NO: 20557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgaccggttgtgcgtttaatacttggtac

SEQ ID NO: 20558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgacctgcctatgtcgctataggggttct

SEQ ID NO: 20559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgactgaccttgtgccgtcttgtatgctc

SEQ ID NO: 20560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgactgcggctattgcagataggttggtg

SEQ ID NO: 20561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagaagaccgttgccgttcctcgtttcc

SEQ ID NO: 20562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagcaaagcggcgtcacacttcttacgc

SEQ ID NO: 20563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagcaatggaacaacgtaatgccaggtg

SEQ ID NO: 20564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagcaggctattagctcaggtgttttcg

SEQ ID NO: 20565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagcatgaagtaggaaattgcgcctcgg

SEQ ID NO: 20566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagcctgtatggcccttgtcggtggtcc

SEQ ID NO: 20567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagctcgaatgcagactgcgtatgccta

SEQ ID NO: 20568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagctcgctcagtaaggtaaggcaacgg

SEQ ID NO: 20569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagtagcaatagtggatatacggcattg

SEQ ID NO: 20570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagtggacacgtatcacgacaaggcgcc

SEQ ID NO: 20571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagttaacccaacggtgccgcatatccc

SEQ ID NO: 20572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagttcagactgtcccggatcgagctgc

SEQ ID NO: 20573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgagttccatgggctgctctctggtgtac

SEQ ID NO: 20574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgataaggctagcccgtgcccctgcgtat

SEQ ID NO: 20575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgataccgaacacttttcaaggagcaccc

SEQ ID NO: 20576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgatcatttgcgagtagccccagcgtggt

SEQ ID NO: 20577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgatcggacaataacagcatgcaatgtgt

SEQ ID NO: 20578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgatggaccgtgataccaaaggactgttc

SEQ ID NO: 20579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgatggtcgttgtttagactggcgggaca

SEQ ID NO: 20580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgatgtcgctccagtatcctgctgctgtg

SEQ ID NO: 20581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgattaccgtgcgtaattctttttgaccc

SEQ ID NO: 20582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgattcaatccatgacgtgcattaccccg

SEQ ID NO: 20583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcaaactattgctcattgtttttcatca

SEQ ID NO: 20584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcaagatctgcaatcggcagtggccatt

SEQ ID NO: 20585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcaaggcgattcgtagccgttcctcgta

SEQ ID NO: 20586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcaatatcagtagggagtgtgctcatcg

SEQ ID NO: 20587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcacggctaggatcaacttccccgcgcc

SEQ ID NO: 20588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcacttcccataaaagaacggcccgtgc

SEQ ID NO: 20589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcaggacgagcaataccgatactgttgg

SEQ ID NO: 20590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcagtgatatccaccgtctctcccgtgc

SEQ ID NO: 20591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcagtgtactgatatggcgtccggtgcc

SEQ ID NO: 20592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcatcttgagggctgcgacattgccccg

SEQ ID NO: 20593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcatgatgggccgggcgtcctgaggtta

SEQ ID NO: 20594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcatggagctaatgatttggcggccagt

SEQ ID NO: 20595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgccgaactgtatcgaggctcctggcgga

SEQ ID NO: 20596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgccgatggagcgcttttccgctgtcacc

SEQ ID NO: 20597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgccgattggtgcgagccctgccatgcgg

SEQ ID NO: 20598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgccgccggtcgttaaatcaagatgggcc

SEQ ID NO: 20599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgccgcgttatctttatagcgcctcagta

SEQ ID NO: 20600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcctacctatttatgtgccaggaaactc

SEQ ID NO: 20601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgattcctgttagaccgggttccgtcg

SEQ ID NO: 20602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgcagttcattgccagcagcggtttgg

SEQ ID NO: 20603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgcataaagaactgcatatacacggca

SEQ ID NO: 20604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgctactacagctatcctgatttctgt

SEQ ID NO: 20605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcggctgccgtacggtatagcgaccgcc

SEQ ID NO: 20606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcggtctgaggcgttacattgctatggg

SEQ ID NO: 20607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgtcttatgaaggtcaagccgccgatg

SEQ ID NO: 20608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgtgggttacgtgcaatcgctgccgtc

SEQ ID NO: 20609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgcgttgagctgtcgatgcgtcggttccg

SEQ ID NO: 20610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctatcccccacaacattatactgctca

SEQ ID NO: 20611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctcaaggtcaaccacatgattgcggtc

SEQ ID NO: 20612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctccgttcggctcagcagacgtgcatt

SEQ ID NO: 20613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctcgcatgatctttactgcgtgaggcc

SEQ ID NO: 20614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctggctcaactaccgattgccgaaacc

SEQ ID NO: 20615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctgtcagtccgggctgtccgccgtgta

SEQ ID NO: 20616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgctgtgttgcgtgtatgatgaatttagg

SEQ ID NO: 20617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggacacatgtaagatttcttctggcagt

SEQ ID NO: 20618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggacctctgaaaatgccgtttcgaggat

SEQ ID NO: 20619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggactccaccgctctacaaggccacgaa

SEQ ID NO: 20620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggactttcgctcgctacggattccctgc

SEQ ID NO: 20621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggagactgacattgtctgcttcgttttt

SEQ ID NO: 20622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggatcaaggcggacaccccacgactgcg

SEQ ID NO: 20623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggcagaggccacgcgtctccttttgtcc

SEQ ID NO: 20624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggcattatggataattggaaatatttac

SEQ ID NO: 20625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggccgtcgctgttggttagggcgtagtg

SEQ ID NO: 20626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggcctaacaatagcccagatatccctgg

SEQ ID NO: 20627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggcgtacactagcacgtaacctgcagcg

SEQ ID NO: 20628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggctcgcaaagaccccccgtttgaggat

SEQ ID NO: 20629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggctgtacacctggagaccgttgctctc

SEQ ID NO: 20630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggggctggttctggtacggtctaggtac

SEQ ID NO: 20631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgggggtctctccgctctcaagcgctcgg

SEQ ID NO: 20632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgggggtggtccaacatggtgtgtgggca

SEQ ID NO: 20633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgggttattacagggcgtcgactacgtac

SEQ ID NO: 20634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtacgatatgtcgccgacacagacttt

SEQ ID NO: 20635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtagcagggcgtctgtcggaactaccg

SEQ ID NO: 20636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtagcgtatgagtgttcttgggaccat

SEQ ID NO: 20637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtccgttcgaccaaggagtgtgaggta

SEQ ID NO: 20638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtcgctccacagtcgttggttccccac

SEQ ID NO: 20639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtcgggatgggcttttaaacattggat

SEQ ID NO: 20640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtctcccctcgaactcttgtagtcccg

SEQ ID NO: 20641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtggttggcaacgcgccgctatcgagg

SEQ ID NO: 20642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtgtttgccccgtcatagagcccaatc

SEQ ID NO: 20643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccggtttctcgcacattttcgcttcgtgtc

SEQ ID NO: 20644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtaagccaaagagcgcccaagctaccgg

SEQ ID NO: 20645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtacagctagcgtctggtttcgccgttt

SEQ ID NO: 20646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtacgattaccatcgctagaatttggcg

SEQ ID NO: 20647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtacgccgtgctgttttgctctcggtct

SEQ ID NO: 20648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtagccccggagcacagccgactagcgg

SEQ ID NO: 20649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtaggcggacggttagagcgaattggcc

SEQ ID NO: 20650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtaggtcactgatccgttggggtctctt

SEQ ID NO: 20651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtatagacatcgaggaccgtcatttatc

SEQ ID NO: 20652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtatcccattgtgggaattgtcctgcct

SEQ ID NO: 20653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtatcgtcaggttcctccatttgccggt

SEQ ID NO: 20654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtcagatagtcgggctcactatatgact

SEQ ID NO: 20655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtcatatacagcggacgttccctttcgt

SEQ ID NO: 20656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtccaattaaggccaggatcccggcgaa

SEQ ID NO: 20657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtccccggactgtggaactccgacgcgt

SEQ ID NO: 20658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtcgtggttgtcacgttagtcgcgcttg

SEQ ID NO: 20659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgaacgaactacgcatagccggaaccc

SEQ ID NO: 20660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgaccctcattacagtttagcatatga

SEQ ID NO: 20661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgacgctgccccttctgtccgcttggg

SEQ ID NO: 20662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgcagtcctgactcatgtggccgcgca

SEQ ID NO: 20663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgcagtgggattgcgcatacgtctcct

SEQ ID NO: 20664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgtgatgctgtcagaacttgatcttga

SEQ ID NO: 20665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgtgggtattgtttcccaaacgctcgc

SEQ ID NO: 20666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgttgtgtgtatgtgcggtgttgtcgg

SEQ ID NO: 20667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtgtttttcacctgcactatgtcgctcg

SEQ ID NO: 20668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttagcggctcgagtcatacctccgtgt

SEQ ID NO: 20669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttcagcggctgccccgtgatggatcgg

SEQ ID NO: 20670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttcgcgccaacatgccggtttgagggc

SEQ ID NO: 20671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttctggcacagtgttccgcgactactg

SEQ ID NO: 20672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttgctcgtctcgtttagagtaccagta

SEQ ID NO: 20673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtttcacccggacagtttattcggagat

SEQ ID NO: 20674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtttcatgtgtggcatctgactcgcgtg

SEQ ID NO: 20675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtttgactgtttgggtgcttcgtcggcc

SEQ ID NO: 20676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtttgctcatctgagtactcgtcggata

SEQ ID NO: 20677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgttttctgctttgggaaagactgtactc

SEQ ID NO: 20678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccgtttttgattcaattggtcgagctgtgc

SEQ ID NO: 20679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctaaacaatcgtagcctggcgtgaccatt

SEQ ID NO: 20680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctaacgtactacccgtcacgtggtcttac

SEQ ID NO: 20681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctaactcgccttcgggaagactttaggcg

SEQ ID NO: 20682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctaccggctcattttcacatggcacagaa

SEQ ID NO: 20683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctacgtatcaggagcctggactggaccgc

SEQ ID NO: 20684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctacgttggtgacaccgtgacggcaccta

SEQ ID NO: 20685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctacttagcattgcttcaagaacaggcct

SEQ ID NO: 20686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctagactatgagacaggctgcgttcatgg

SEQ ID NO: 20687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctagcaagcgttgccctactcgggacatg

SEQ ID NO: 20688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctagctgcacacaccttgcacttccgggg

SEQ ID NO: 20689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctagggtaaacactacaccgcccttcacc

SEQ ID NO: 20690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctagtggatcccgaatctcgactgcgccg

SEQ ID NO: 20691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctataggcgaggcccgcgaggcccttcgg

SEQ ID NO: 20692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctatcgctgcttggacaccggttgctggg

SEQ ID NO: 20693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcaccaaaagtgtatgttgtctcacggt

SEQ ID NO: 20694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcaccataggccatagcacttaccgtgg

SEQ ID NO: 20695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcaccgtgacctgaacgagagtagggca

SEQ ID NO: 20696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcacggtcttgcaatacggtgtgctcta

SEQ ID NO: 20697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcagctctagaatcctcctctatcgcca

SEQ ID NO: 20698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcatcgttttcgccggatgtatgaggcg

SEQ ID NO: 20699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcccctccactgttttggctatgacatg

SEQ ID NO: 20700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgatcgttgcccggtaaggcacaggtg

SEQ ID NO: 20701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgcacctgcaggaccgatcgcggagga

SEQ ID NO: 20702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgccgcagtatgcgacatttggcatgc

SEQ ID NO: 20703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgggattcagtctgatctcatgcctcg

SEQ ID NO: 20704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcggtggttcaacggagtccatttgcgt

SEQ ID NO: 20705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgtacggcggtctcgcaagctcggcgg

SEQ ID NO: 20706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgtagctgtgctcttggcccggttcgc

SEQ ID NO: 20707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctcgttataagtcgatataggttacgtgc

SEQ ID NO: 20708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctctcgctgttgcattaaccgacattggc

SEQ ID NO: 20709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctctcggctttctagtacactgtcgcacg

SEQ ID NO: 20710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctctgatttatacgtgcgcttgctcggcc

SEQ ID NO: 20711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctctgctggttaggacgtatcctgtgggg

SEQ ID NO: 20712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgacaattttcgcagattattgatggct

SEQ ID NO: 20713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgacatctgcatgttatcaaaagcccca

SEQ ID NO: 20714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgacgcacccgagcatcatcggaatctc

SEQ ID NO: 20715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgactcgggcggatctcacgcaaccagc

SEQ ID NO: 20716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgatctcgtgtccaattgacggcagcct

SEQ ID NO: 20717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgatgtgacccgtgctatagccaacaac

SEQ ID NO: 20718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcagccgcgcgaatcaacactggcggg

SEQ ID NO: 20719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcagcgctttacacgagttcagcagat

SEQ ID NO: 20720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcattaatgaggattagtttttgtgtt

SEQ ID NO: 20721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgccgctgcggtactccataatgatctc

SEQ ID NO: 20722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcgaagggacaagcgtgcatgtttcat

SEQ ID NO: 20723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcgcattccgtgtcgcgtttgctagga

SEQ ID NO: 20724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcgtaggatgacagaccatttactgga

SEQ ID NO: 20725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcgtcccatgaaatgttcttcgtggcc

SEQ ID NO: 20726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgcgtctcccgccatgaccatccagtgt

SEQ ID NO: 20727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgctcttggtagttggctatcgcggttt

SEQ ID NO: 20728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgctgtgatgaatgtccaatcggtgtcg

SEQ ID NO: 20729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctggagctcgacctcttgggaatgcatta

SEQ ID NO: 20730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctggagggcacgggataggcgaccacaca

SEQ ID NO: 20731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctggatacctgtcaaacttgttgggtccg

SEQ ID NO: 20732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctggcaggatgggttttgtattgatgtta

SEQ ID NO: 20733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgggacgacctactaccacttcctggct

SEQ ID NO: 20734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgggattttgggctagtccacgggcaga

SEQ ID NO: 20735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctggggaaggatggtgttacgatttggtg

SEQ ID NO: 20736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgggtctggtaaggcgaccaccctacgt

SEQ ID NO: 20737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgggttacggtcgattttaactatggat

SEQ ID NO: 20738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgtggcagcgatcagatgcaaagttcac

SEQ ID NO: 20739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgtgtcgccgtcatgccgctgtcgcacg

SEQ ID NO: 20740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctgtttgtacgcttgttcgtgggccggaa

SEQ ID NO: 20741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttacgtcagagtggctgggggatggtct

SEQ ID NO: 20742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttactggcggggtggcaggcaacggacg

SEQ ID NO: 20743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttagctaagcttcgaccagggggatttg

SEQ ID NO: 20744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttcaggaacattggagaatgatcatcca

SEQ ID NO: 20745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttccttattacgttggatgaatcaaata

SEQ ID NO: 20746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttcggtcacgggttgttgtgccccactt

SEQ ID NO: 20747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttctcgctcaaccctagatagctcaatg

SEQ ID NO: 20748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgaccccactgtcctacgcagcggagc

SEQ ID NO: 20749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgccgagttagtactatgcccctctgc

SEQ ID NO: 20750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgcgccgttacgtcctcgcgtacctca

SEQ ID NO: 20751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttggttcttgactttttgaagcatgctt

SEQ ID NO: 20752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgtctactcgtcagtcggacgcatcgt

SEQ ID NO: 20753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgtctgaaccatgcctaccgttttgat

SEQ ID NO: 20754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgtcttgcagctcccgcctgatcgcct

SEQ ID NO: 20755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgttgtggcagtacagagagaccgctg

SEQ ID NO: 20756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttgtttgggagtgtgtgtttcctcttaa

SEQ ID NO: 20757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctttactcgggtgcacttggtaggaattc

SEQ ID NO: 20758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctttccagcggagtgttagggatatgacc

SEQ ID NO: 20759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctttggtgcgacatccgcctcatacagcc

SEQ ID NO: 20760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccctttgtccaacatgaggaatacgaggatt

SEQ ID NO: 20761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttttcaggtgcttggaggtatcttgtct

SEQ ID NO: 20762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttttgggcttcgagcgattccgggcgat

SEQ ID NO: 20763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccccttttgtgacacagtatctaacgttcctc

SEQ ID NO: 20764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaaactcactcgcggcggggtttgatta

SEQ ID NO: 20765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaaaggctggtgttgggtggggggtgcg

SEQ ID NO: 20766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaacccgccattgttcttctgactaacc

SEQ ID NO: 20767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaagatcattaggttttttcagattaga

SEQ ID NO: 20768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaagcgtcataccggcgccgtttcacac

SEQ ID NO: 20769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaaatagggggacccgatctgcacttgtg

SEQ ID NO: 20770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacccgtgcatggcgtccttgtggtttg

SEQ ID NO: 20771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacgcgtctttcgttcactaagccgcac

SEQ ID NO: 20772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacgctcgtcctgcccttctcgatcagt

SEQ ID NO: 20773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacgtatacgtcgatgctgggatcatcg

SEQ ID NO: 20774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacgtctagacgcccataggtggaccct

SEQ ID NO: 20775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaacgtgcaagacgacacttcgcgtcaca

SEQ ID NO: 20776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaactattccagcccacttccgacgtcgt

SEQ ID NO: 20777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaactctatcgcgtaacacctcgccgacg

SEQ ID NO: 20778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaagcaaccgcattgggtacaggcctaac

SEQ ID NO: 20779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaagcaagatcagaggcggttgacggacg

SEQ ID NO: 20780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaagcagcgtttgggtggttgtggcgtat

SEQ ID NO: 20781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaataacggttaagtcaaacgggaattat

SEQ ID NO: 20782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaataatggcccagatccggatctgcaac

SEQ ID NO: 20783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaatccgccaatgtttatttatatcgaga

SEQ ID NO: 20784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaatgcccaaggatgctcattacagtgca

SEQ ID NO: 20785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaatttgcatgcatcgtcgtaacgcaccg

SEQ ID NO: 20786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacaacaagaactcccaagcgttgcagag

SEQ ID NO: 20787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacacattagcctgcccgattctaggtgc

SEQ ID NO: 20788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacaccggaaatgagtgttgcaccggtcc

SEQ ID NO: 20789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacagactatgattacaacactcagcaat

SEQ ID NO: 20790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacagcacactcagccgtagatctcgggg

SEQ ID NO: 20791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacagtcattatagctttgcacggcactg

SEQ ID NO: 20792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccaatccgggcaatcgttgcagtaata

SEQ ID NO: 20793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccacgcggttagtagcactcgtatggc

SEQ ID NO: 20794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccacgttgcgtaagcgataagatgttg

SEQ ID NO: 20795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacccaccgcacgctctcctgccgacacg

SEQ ID NO: 20796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacccacgcgcgtgtgcagcatgattcgt

SEQ ID NO: 20797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccgctccgcgacggactagtccaatcc

SEQ ID NO: 20798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccgctcgtcccgtgtcactgttgctga

SEQ ID NO: 20799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccgtggtggagccttgacaccgctgcg

SEQ ID NO: 20800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacctaatccaaaaatgcgcgtatggcac

SEQ ID NO: 20801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaccttattctagctcgcgtagactgggg

SEQ ID NO: 20802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgagactccgacgacagttccggttcg

SEQ ID NO: 20803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgaggacagacagtggagctgctggtt

SEQ ID NO: 20804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgcagcataatgcagccgtgggtgaac

SEQ ID NO: 20805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgccgctggcgatggcgaaactcaatc

SEQ ID NO: 20806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacggcaagacttacgtacgtccccatta

SEQ ID NO: 20807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacggtaacaatggctgatagatcggaag

SEQ ID NO: 20808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgtaatggagcgccagccacctcgtgt

SEQ ID NO: 20809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgtgaagggctgcacctggaaagccgg

SEQ ID NO: 20810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgacgttttcgcactccgcctgtggcacgc

SEQ ID NO: 20811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactagtgaacggactcgcgttctacatg

SEQ ID NO: 20812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactagtttgttcaactgcatctgagagt

SEQ ID NO: 20813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactgcttaaatggggcggccggtctagc

SEQ ID NO: 20814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactggatgcagtggttagcgttagcgcc

SEQ ID NO: 20815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactggccgctgacgccatcgactgtcac

SEQ ID NO: 20816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgactttgaagcacgtgttggtgttacctg

SEQ ID NO: 20817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagaactcgagcgttttaggtagcgttca

SEQ ID NO: 20818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagaccgcgcaagcagaaatgcatcctcg

SEQ ID NO: 20819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagacgaaaaacggcttttcacgtctagc

SEQ ID NO: 20820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagagtataagaaagagtcgtgcttgacg

SEQ ID NO: 20821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagatcacttaaagcagaagaccccagtt

SEQ ID NO: 20822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagatcctcagcagcgtctgcaacgtatg

SEQ ID NO: 20823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagcaagctgggatggcagtttatgcgaa

SEQ ID NO: 20824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagccacgggttggctgatactgcccgag

SEQ ID NO: 20825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagcccatgtcacggagtagtgcaatatc

SEQ ID NO: 20826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagctaccaaggccgcaatgcccggggcg

SEQ ID NO: 20827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggaacttccctgatttggtgcgggact

SEQ ID NO: 20828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggaagatggatcttggatagcctgcgc

SEQ ID NO: 20829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggacgcgtatatgtgcaagcattatag

SEQ ID NO: 20830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggatgtaacgagttgtggggattgtct

SEQ ID NO: 20831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggcacagggctacacgtggtaggtgtg

SEQ ID NO: 20832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggccttacttttcccccgacagcgacc

SEQ ID NO: 20833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggctaaggcttatgttgctcaggctgg

SEQ ID NO: 20834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggtcaacaataaactatctgtcgtggg

SEQ ID NO: 20835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgaggtggttaggtctcgacgcaaacctca

SEQ ID NO: 20836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagtatacactttaacaacacgctgtata

SEQ ID NO: 20837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagtcacctgcacgagcaccgtttccaga

SEQ ID NO: 20838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagtcgcttcgaatcaacgggtacgggtc

SEQ ID NO: 20839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagtggacatgatagtgccaccctgtact

SEQ ID NO: 20840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagtgtccgcgtcgatcccgagggggagt

SEQ ID NO: 20841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagttagactgggtcgcacatttgcttcg

SEQ ID NO: 20842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagttccgtatacatggagtctttggtcg

SEQ ID NO: 20843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgagttttatgacttcggaattgtgaggaa

SEQ ID NO: 20844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgataaaggcaagggtaaggctggtttcta

SEQ ID NO: 20845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgataagcagagaaccataagtcttgttct

SEQ ID NO: 20846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgataatgataatgggttgcaccgtttagc

SEQ ID NO: 20847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgataccacgatggggtcgtccgtgcaatc

SEQ ID NO: 20848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatagaggcagcgacgatggcagtgaccg

SEQ ID NO: 20849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatatctgatcacagtgctccagatcctg

SEQ ID NO: 20850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatatttacactattccgtaatccagggg

SEQ ID NO: 20851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcaagttcctcctcttgaccaccgttc

SEQ ID NO: 20852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcatttgcttctcccgcacagtgagcg

SEQ ID NO: 20853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatccaactaccactgagcggtatagcac

SEQ ID NO: 20854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatccaagcaactgcacacagtgcgtggc

SEQ ID NO: 20855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcccttcaacctgcacgtgcaagtcgg

SEQ ID NO: 20856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatccggaccgtagctctatctagtttat

SEQ ID NO: 20857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatccggtgattcatacgctcgtgaatcg

SEQ ID NO: 20858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcctagggaattttcccgtttgttttg

SEQ ID NO: 20859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcctattgagcgccagcggcacattgt

SEQ ID NO: 20860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcctcagtataggcgcgcacctagtac

SEQ ID NO: 20861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcgatatgttcccgttcacgagttacc

SEQ ID NO: 20862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcgcgagtgcgtcgatgatcataatcg

SEQ ID NO: 20863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcggtcacctggaggttattgccccgt

SEQ ID NO: 20864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcggtctgtttctgcaaccccgtcgca

SEQ ID NO: 20865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcgtacttcgggattccgcgagaacct

SEQ ID NO: 20866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcgttacagcgaaacgacttcttctgg

SEQ ID NO: 20867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatcgtttatctgaccccagggggttgac

SEQ ID NO: 20868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatctggacaatttgaggataacacgcta

SEQ ID NO: 20869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatctgtcccgggattgctgatgtttgaa

SEQ ID NO: 20870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgaccgcgcgaaaagatcgcaatgcga

SEQ ID NO: 20871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgactgacgttgggtcactcttggtta

SEQ ID NO: 20872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgagggaacacatccacgctgtagaaa

SEQ ID NO: 20873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgatacatgcggtgggatttatgcgtc

SEQ ID NO: 20874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgcgtttacaaggaacacttttcagcg

SEQ ID NO: 20875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatggcagtgatccgtcgtggtggcccgg

SEQ ID NO: 20876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgggtgcccgtcgcattgtggactgta

SEQ ID NO: 20877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgatgtctcaatttgatgcatatttgtcgg

SEQ ID NO: 20878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattcaattagtttcttgtactgcctatt

SEQ ID NO: 20879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattcgttcaggtacggaacaaggcgaag

SEQ ID NO: 20880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattctcgaactgaaacgccgagacttga

SEQ ID NO: 20881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattgattttgtagtgacgataaaccgcc

SEQ ID NO: 20882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattgggcttagtcgttcaccatttacgt

SEQ ID NO: 20883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattgtcgagggtatgactgataatctga

SEQ ID NO: 20884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattgtgctatggcgtaacagttactttt

SEQ ID NO: 20885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgattttggtaccgcggggatccgcgtctg

SEQ ID NO: 20886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaaacgattccgtattttgccgaactgc

SEQ ID NO: 20887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaactcaagcatccattggcaaaccggt

SEQ ID NO: 20888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaacttggtgtaacatttcacgcaatcg

SEQ ID NO: 20889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaagccagctacgcgtcaaccccagcgg

SEQ ID NO: 20890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaaggaacccagtttgcaagcctatccg

SEQ ID NO: 20891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaagtgtggttccgttcttagtggtgca

SEQ ID NO: 20892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaatcagtccacccgcttgggacacccg

SEQ ID NO: 20893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaatcgcgagtatagcctgcggcgtgtc

SEQ ID NO: 20894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaatgaatgtgcgcctctcattcccccg

SEQ ID NO: 20895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacaagtctggtatgcttcggtactggg

SEQ ID NO: 20896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacaatgtataccggcgaaatacagtca

SEQ ID NO: 20897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacaccgtgttctcgtccgatgggtgtc

SEQ ID NO: 20898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacactgagtcgatcctatcattctagc

SEQ ID NO: 20899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaccgatgccagacgaatttgacgcttt

SEQ ID NO: 20900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaccttaggctcgcccgacttgtaggtc

SEQ ID NO: 20901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacgccaacaggcagaaacctcggtacg

SEQ ID NO: 20902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcacggacttttattggcaccgtgaccgc

SEQ ID NO: 20903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcactcattgtttaatttcttttggggac

SEQ ID NO: 20904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcactgacggacctaacgtccctctcgaa

SEQ ID NO: 20905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagaaagctggatgtagaccgtacttat

SEQ ID NO: 20906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagacactcagcggacgtggaccgcgtt

SEQ ID NO: 20907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagatcccgctccaatatatcttttggc

SEQ ID NO: 20908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagccgtgtctgtcatcgcacgtgtctg

SEQ ID NO: 20909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagcgagatcttactccttctgtacgaa

SEQ ID NO: 20910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagcgttgtcctgtctattaactatccg

SEQ ID NO: 20911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagctaattagaagaccgctagagcatc

SEQ ID NO: 20912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaggataggtaagtgcggcgctaaaagc

SEQ ID NO: 20913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaggggttcaagttccgcagtacgcatc

SEQ ID NO: 20914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcaggttatccgacttacaagatcttgag

SEQ ID NO: 20915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagtatgcggttgtgcaggtctgggatg

SEQ ID NO: 20916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagtcacacggcagcccggatgtttgat

SEQ ID NO: 20917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagtcgataagctcttcggtactagtag

SEQ ID NO: 20918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagtctctccggattgtttgcgttttag

SEQ ID NO: 20919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcagttcacacccgtgttagaattctttt

SEQ ID NO: 20920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcataatggtaatgaccaatctggctttt

SEQ ID NO: 20921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatacaagtcctatcgcacccgctggct

SEQ ID NO: 20922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatattcaccaggacctcgttggctcgt

SEQ ID NO: 20923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatcaggtccccggttttcatatcttgg

SEQ ID NO: 20924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatcgtcaattcactctctctagtcatg

SEQ ID NO: 20925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatgacgtcacttgcatgaggcacttag

SEQ ID NO: 20926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcatgtcgctacaggtttctttacccgct

SEQ ID NO: 20927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccaatcattccattcaggatacgcgtgg

SEQ ID NO: 20928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccaccacgacagccataagtggttatag

SEQ ID NO: 20929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccacgcccgtcctgaaacctcctcgtgc

SEQ ID NO: 20930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccagcgacgacgacatttcttgtacacg

SEQ ID NO: 20931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccagtattaccggttgtgatcgatttac

SEQ ID NO: 20932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccatcaccacgaccctctcttaggctcg

SEQ ID NO: 20933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccatccagactgagcttcgattgttgtg

SEQ ID NO: 20934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccatcggtccccagtcagcctgtgttcg

SEQ ID NO: 20935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccatttcaatccgccatcccctggacat

SEQ ID NO: 20936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccaaactctccttgaacgacgctgcct

SEQ ID NO: 20937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccaacacggaaggtacttgactcgagt

SEQ ID NO: 20938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccaacttctgtgccatctggcggtgtg

SEQ ID NO: 20939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccagccttgcgtatactcgcgtttcgt

SEQ ID NO: 20940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccatcgtatcccaaacatacagttgac

SEQ ID NO: 20941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccccatgccaccgtattcctttgtccgc

SEQ ID NO: 20942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccccttacgccgtccgctgtaacgtgg

SEQ ID NO: 20943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccccgaagtctataaaccaaagctgctg

SEQ ID NO: 20944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccccgtgagccagacgattgggtggttc

SEQ ID NO: 20945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccgatgttggtgcttaaccgacagtac

SEQ ID NO: 20946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccgggtatggcccaacgactaagcgcg

SEQ ID NO: 20947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccgtcaggtgcagccattaatacactc

SEQ ID NO: 20948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccctcgttcatcccggacaacctgtaat

SEQ ID NO: 20949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccctctttaaccattgctatgttttgcg

SEQ ID NO: 20950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccctgccgcacttcccgtaccccaggag

SEQ ID NO: 20951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcccttcacggttagtatgagggttgtca

SEQ ID NO: 20952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgacctgcaactaggctatagtttgga

SEQ ID NO: 20953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgagttgcaggcacacatcgcagtaac

SEQ ID NO: 20954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgatcactgcgtctgcaccggtcacat

SEQ ID NO: 20955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgatgttaaaagagcgttgcgtgccac

SEQ ID NO: 20956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgcggccgaggataccatgcaaacgtt

SEQ ID NO: 20957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgtacgaatcaaagatctcctccgtgg

SEQ ID NO: 20958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgtatgcgcaattgtttccggctctac

SEQ ID NO: 20959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgtcattgcattacagtaatccggtcg

SEQ ID NO: 20960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgtgtggttctgactccgttgcatccg

SEQ ID NO: 20961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgtttctcattcactctggattttatg

SEQ ID NO: 20962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgccgttttattcgataacggtcatttgac

SEQ ID NO: 20963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctagactccgggcaaggctgcctcgtg

SEQ ID NO: 20964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctagcaattactcgccgctgagtggtg

SEQ ID NO: 20965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctatctagtggtggtacctccgcgacc

SEQ ID NO: 20966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctcgcaatgacttccacagtcgatcgg

SEQ ID NO: 20967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctcggacacaaggcaattatgccccat

SEQ ID NO: 20968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctcggtcttcattggtgaccgcacacg

SEQ ID NO: 20969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctctgtaggaaacatctgagataccaa

SEQ ID NO: 20970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcctttccgcgactggttgcgtacgtgca

SEQ ID NO: 20971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgaaaggcagattgcggctgtttgtttg

SEQ ID NO: 20972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgaagaatggagaaccgttggtgggacg

SEQ ID NO: 20973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgaatggaaacatatttggcttgccatg

SEQ ID NO: 20974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgacggtgggcccagagatgtgcgctgt

SEQ ID NO: 20975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgacgtttgttatcttgtggcgtgactc

SEQ ID NO: 20976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgaggtagggtcgtctacacgggtgggt

SEQ ID NO: 20977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgaggtatgggtagggcgtactggctgc

SEQ ID NO: 20978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgagtagacgcccgggagctcgataagc

SEQ ID NO: 20979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgagtcgcgccgcacgacaggatatgac

SEQ ID NO: 20980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgatccaacggcacaaggttactctcgg

SEQ ID NO: 20981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgatcgaaaattaaagtactttgcatgt

SEQ ID NO: 20982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgattatcattgtaaacctaagcagtgg

SEQ ID NO: 20983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgcaccggcgcacaacgtgatgggaccg

SEQ ID NO: 20984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgcagcctggtgctcatcgatagtagat

SEQ ID NO: 20985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgcatgacccacacgcgacccgtcgggt

SEQ ID NO: 20986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgccaaccggacgtagtaccggcacaat

SEQ ID NO: 20987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgccgcatgtggttgctgtgttgctggt

SEQ ID NO: 20988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgccggcctgcgtactgatgatgctccg

SEQ ID NO: 20989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgcgaagtggacaatgatttgcaacgtt

SEQ ID NO: 20990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgcgctctcgaacagtcatggttggttc

SEQ ID NO: 20991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgctctgtcagcagtactctcctaacag

SEQ ID NO: 20992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgctctgtgaccaataatttatttgaat

SEQ ID NO: 20993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggaaactggtcgcggagtttggcgttc

SEQ ID NO: 20994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggaatataacgatcggaacggtggatg

SEQ ID NO: 20995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggaatcactcaacaggcagtttttctg

SEQ ID NO: 20996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggacggtcgtacagcccgccagtttag

SEQ ID NO: 20997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggacgtgattcaccaacgacggcgttt

SEQ ID NO: 20998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggagcaactccaaccatgtagggtggg

SEQ ID NO: 20999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggcattcacttgtacccgtggttagcg

SEQ ID NO: 21000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggcgagggtaccgggcgcgattgctaa

SEQ ID NO: 21001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggctgagcccgcattcgaaatagcggg

SEQ ID NO: 21002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggctggattactgtctccgttcgttcg

SEQ ID NO: 21003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgggataggtgacgccacgtttgttagt

SEQ ID NO: 21004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggtagcctcctcgttgtcatatcctga

SEQ ID NO: 21005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggtcgtgataggtttttcccttttccc

SEQ ID NO: 21006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcggttagaagtcaaacaatactcgagtg

SEQ ID NO: 21007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtaaagagtggggtgtccagaccgcca

SEQ ID NO: 21008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtaatgttggattactatgcgagagtg

SEQ ID NO: 21009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtactttaggaagataacctggatttt

SEQ ID NO: 21010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtcatcggtatctacgggtggtgttag

SEQ ID NO: 21011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtccggtagaactaatgagcgaggcta

SEQ ID NO: 21012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtcgagtgtacgtggcatcgtattccc

SEQ ID NO: 21013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtggcaggacttgcgcttgattgtgtt

SEQ ID NO: 21014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtgtagagcgataacctgacgcacagt

SEQ ID NO: 21015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgttcggacggggaatcggtcccacgct

SEQ ID NO: 21016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcgtttccgtggtataagtttcgcggcgg

SEQ ID NO: 21017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctaaggcagtctcgtccccaatcccttg

SEQ ID NO: 21018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctacatgatgggggtcgctggaggcttc

SEQ ID NO: 21019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctactggttgtttgggttctgattctgc

SEQ ID NO: 21020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctagtttccgcgcgcatccacggcgtgt

SEQ ID NO: 21021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctatcagtgatagtaaatatggctggcg

SEQ ID NO: 21022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctatgtgcgaacgcttgcattaaccatc

SEQ ID NO: 21023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctattgatctgccgtttacgctccagcg

SEQ ID NO: 21024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcaaggcgttggccagttgtggggctg

SEQ ID NO: 21025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcacccaatctaatgcacaggtgtatg

SEQ ID NO: 21026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcaggcgcaactgatttggattggagc

SEQ ID NO: 21027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcattggtgcttggagtcaaatcgccc

SEQ ID NO: 21028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcccgaactgtcaggtggttattcgtt

SEQ ID NO: 21029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctccgacgcctggtacactgacacgcga

SEQ ID NO: 21030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcgcagacaggcatacgtcctcggagc

SEQ ID NO: 21031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcgtaaggccacctcgccctcttgctt

SEQ ID NO: 21032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcgtctcggcgtggtgttacagcttac

SEQ ID NO: 21033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcgttcgtaggcgtactgcttgtgttc

SEQ ID NO: 21034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcgtttcggacagtgcacagcagtatg

SEQ ID NO: 21035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctctcctcgagtgtaaagcgctttatca

SEQ ID NO: 21036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcttggcactctcgattgttgattgac

SEQ ID NO: 21037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctcttgtgtgtcaacaggcgagtacgtt

SEQ ID NO: 21038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgaacacacaggcttttaagatgttct

SEQ ID NO: 21039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgaacgagagcctacctcgagcatgtg

SEQ ID NO: 21040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgcatatctcacaccaggctatcctgg

SEQ ID NO: 21041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgctatccgttaaacgtgtcgaatgca

SEQ ID NO: 21042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgctctattgccttggtacagtcgagc

SEQ ID NO: 21043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgcttagattctttagtccggatgaac

SEQ ID NO: 21044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctggagtctctgagaccattcgcgcccg

SEQ ID NO: 21045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctggtcttataatcttgtctgatggctc

SEQ ID NO: 21046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctgtccgttctggccgtggatatcatca

SEQ ID NO: 21047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttacgccagtcgtcaaaattttagggt

SEQ ID NO: 21048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttattgccacaatcttgctcggagcgc

SEQ ID NO: 21049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttcaatgacatctactgtacgtaacgt

SEQ ID NO: 21050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttcctcgtcgctctggagcaacttgga

SEQ ID NO: 21051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttcggacccagtcgtgtattcaggggt

SEQ ID NO: 21052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttctcacaaggaaccttaaaacacgct

SEQ ID NO: 21053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttgtcccccgatgtgttacgatggccg

SEQ ID NO: 21054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttgtgacgtgggggactccatatcgcc

SEQ ID NO: 21055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctttaaaactcgtactagcaggtagacg

SEQ ID NO: 21056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgctttacgtgaatattacctgcttattgg

SEQ ID NO: 21057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgcttttcgtgtgcagagtcagctctggcc

SEQ ID NO: 21058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaaactagagcgtcagccattgactggt

SEQ ID NO: 21059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaaagtggcgtacccaagaagcctgatc

SEQ ID NO: 21060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaacatatctctacctagatgcttggtc

SEQ ID NO: 21061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaacccacgcaaacgaggttgtgttcgt

SEQ ID NO: 21062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaacgcgcgcccaagaactaccgggggg

SEQ ID NO: 21063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaacgtgagtgactaaggttgttgtgcg

SEQ ID NO: 21064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaagattgaccaggtggcgtatgacaag

SEQ ID NO: 21065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaagcccggtagatgacaccactgaccg

SEQ ID NO: 21066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaagcttttcccggattgcaagattgat

SEQ ID NO: 21067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaaggacattgcaccgaaggacgtctgc

SEQ ID NO: 21068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaagtctgccaagaaacatttcgtaact

SEQ ID NO: 21069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaatgtgattcgccattcagaacataaa

SEQ ID NO: 21070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaatttgaccagtctattgcaatgtcca

SEQ ID NO: 21071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacacagggattcgtttatttcacggca

SEQ ID NO: 21072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacagccaccttagtcctaatctgctcg

SEQ ID NO: 21073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacagctgccacttgctctcaatacgcc

SEQ ID NO: 21074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacagtcgtagtgcccgctttcacacgg

SEQ ID NO: 21075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacatggccgaaaggaacataaccaggg

SEQ ID NO: 21076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacccagctcttgtcggcaaatgtgttt

SEQ ID NO: 21077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaccggtataagcgccatgggctgtttc

SEQ ID NO: 21078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaccgtcaggttaagtagagctcctcgc

SEQ ID NO: 21079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacgaattcctaggagaggtgagactgg

SEQ ID NO: 21080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacgatctgcatgttaagccctcacctc

SEQ ID NO: 21081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacgcgccgaacgtgtaccactcactca

SEQ ID NO: 21082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacgcggacggtggtttgcgttgactag

SEQ ID NO: 21083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacgtaatgctactgggcacggtttctt

SEQ ID NO: 21084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggacttgcagtgtaggttgatccatggct

SEQ ID NO: 21085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggagcaagagttggaagccatcattgctc

SEQ ID NO: 21086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggagcacaaacacttcggcctctcttggt

SEQ ID NO: 21087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggagcagtcgatatgtgtcgaagttcagt

SEQ ID NO: 21088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggagcgacggatattcattggagcatggt

SEQ ID NO: 21089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaggagtgttacgaccgtcatgcgcgca

SEQ ID NO: 21090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggaggggttgtacgggattcttcatctgc

SEQ ID NO: 21091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggagtcgccctcttgtgccgagcttctag

SEQ ID NO: 21092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggatacctgggtttgctggtggttttttg

SEQ ID NO: 21093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggatataccgcctatttgcgcctttttgg

SEQ ID NO: 21094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggatcaactgtttcagttctgggcaagcg

SEQ ID NO: 21095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggatcttccaaagtccaagatttgtgttc

SEQ ID NO: 21096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggattaaaacgggtaccacgatcctgttt

SEQ ID NO: 21097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggattaatttaaggccatgcttagatcgt

SEQ ID NO: 21098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggattcagcagtactgtgttgtactttgt

SEQ ID NO: 21099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggattgtctcggtctttgccctgtggatt

SEQ ID NO: 21100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggatttttaaattccatgtaacatagcta

SEQ ID NO: 21101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaaaatcggcaatcgaaaggcaactca

SEQ ID NO: 21102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaaagggatgactaggtaggtcttgtc

SEQ ID NO: 21103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaaccactaggccgaaaggtgcgcagc

SEQ ID NO: 21104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaactatgtgtttctggaggtagtgtc

SEQ ID NO: 21105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaagactggctgaacttgggctgtcac

SEQ ID NO: 21106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaagctgttacaagttagtgttgccct

SEQ ID NO: 21107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcacaagaagctaacaatggcccggtgt

SEQ ID NO: 21108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaccgctacaaggatccagggttgacc

SEQ ID NO: 21109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaccgctgaatacatccggctttaagg

SEQ ID NO: 21110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcacctttgacgctaagctaccttaacc

SEQ ID NO: 21111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcacggatttccgtgtcccacctgcgcg

SEQ ID NO: 21112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcactcgtaggacttaggccgcctcggt

SEQ ID NO: 21113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcacttcggcgccttgcgcggattcttt

SEQ ID NO: 21114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaggaattaccctctggtctgctgcgt

SEQ ID NO: 21115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcaggagcagctggaacgttgcgggggc

SEQ ID NO: 21116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcatcctcaatattgcatgtgaacgggg

SEQ ID NO: 21117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcattggagaattcaataggtgccgtct

SEQ ID NO: 21118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccaaacagcgtttcgaaacgaggtccg

SEQ ID NO: 21119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccatgactccagatggtaaggctaact

SEQ ID NO: 21120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccccgggtcgttgtaagtgtgtgacgg

SEQ ID NO: 21121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcccgaacaagctctaccgtttcgttca

SEQ ID NO: 21122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcccgcgtatgtcggcaccttttttcgt

SEQ ID NO: 21123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccgcattgagccacttcgcccaaatgt

SEQ ID NO: 21124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccgcttgttagcacgatgggtcgctgt

SEQ ID NO: 21125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggccggataatggatctccgcgctgcggg

SEQ ID NO: 21126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcctaggccatagcacttgtttacgcgg

SEQ ID NO: 21127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcctcggtcatgatgtctttcttggtat

SEQ ID NO: 21128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcgatatataagactatatgccaatgat

SEQ ID NO: 21129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcgatggtggtggctacggttttggcga

SEQ ID NO: 21130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcgcatataacacaccgtcgggtgacat

SEQ ID NO: 21131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcgccaccacgctttccacgcattgtag

SEQ ID NO: 21132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcggcagtcatgcaagcgcattcacctt

SEQ ID NO: 21133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcggccgtgcagccaaccatatgggacg

SEQ ID NO: 21134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcggcgcagtagattggcggggcgcatc

SEQ ID NO: 21135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcggttcacttgatcacccccctgcaac

SEQ ID NO: 21136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcgtagactgcagggagctggttatact

SEQ ID NO: 21137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctaagcaggcacggactgaagggtgcg

SEQ ID NO: 21138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctcagacagtggcatcgagcgtccgac

SEQ ID NO: 21139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctcctcgggtagtggaacatgaccatt

SEQ ID NO: 21140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctcgaactacgttgggaactttcaatc

SEQ ID NO: 21141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctcggacactgcaacaggagcttctcg

SEQ ID NO: 21142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctctccaactatgcgtggatccaggta

SEQ ID NO: 21143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctctgagggacggtcttcaattgttcg

SEQ ID NO: 21144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctctgaggtggttccgcagctgtttcg

SEQ ID NO: 21145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctggacgggacatctttcctattcttg

SEQ ID NO: 21146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggctgttttattccctgtgatcttagggg

SEQ ID NO: 21147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcttcagcagcaagatcgttgatggtcg

SEQ ID NO: 21148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcttgcaagtgttgtacgatcattcgtc

SEQ ID NO: 21149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcttgccccttgtgcatggagtcgaacg

SEQ ID NO: 21150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcttgctaacgcgtaactgtttggagtt

SEQ ID NO: 21151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggcttgtttcacccggttggtcaagttag

SEQ ID NO: 21152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaaccacgcttagtcccgcggagggta

SEQ ID NO: 21153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaagccagcgagccaagcgtattgctc

SEQ ID NO: 21154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaatcgaactggctcgcacttcctgtc

SEQ ID NO: 21155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggacatgtgggggcaggttgtattgtgt

SEQ ID NO: 21156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaccgccacggtttaaaccccccgtcg

SEQ ID NO: 21157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggagcagtccacttcgaccgcggcatcg

SEQ ID NO: 21158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggagcgattcattctttgctcgtgctaa

SEQ ID NO: 21159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaggacagtacggacattggtctttgg

SEQ ID NO: 21160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaggtggtgggggaagatctagttagg

SEQ ID NO: 21161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggaggtggtttttgccattgcctgatgg

SEQ ID NO: 21162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggatagtcgttcttgtgcacgatagcgg

SEQ ID NO: 21163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggatccctgttagcacttccaccacacg

SEQ ID NO: 21164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggatggctgtagggtctttcaccgatgt

SEQ ID NO: 21165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcaccgtgagggacgacgtgatttaat

SEQ ID NO: 21166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcagctcacgtgggtgtcctgcgggaa

SEQ ID NO: 21167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcagctggctcaacgatttaggcactc

SEQ ID NO: 21168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcattagctaaatgcaatgggggaggg

SEQ ID NO: 21169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcctggaaacgtcgagcgacctcgtcg

SEQ ID NO: 21170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcgaagggggactcggtatttggagcg

SEQ ID NO: 21171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcgatactctgtgaattacgacgcgaa

SEQ ID NO: 21172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcggactgatctaggattcggtttata

SEQ ID NO: 21173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcggcctcaaacatcggttggtcggca

SEQ ID NO: 21174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcggggagcggcttactgttgaacccg

SEQ ID NO: 21175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcgggtgatactgacacgtcttggcgg

SEQ ID NO: 21176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggcgttgtgttgtttagtggtcacccga

SEQ ID NO: 21177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggactcgagtactaaggtgcatgccaa

SEQ ID NO: 21178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggaggcgctaaaggtgctgtcgggttg

SEQ ID NO: 21179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggggcaaagtctggcgtctgacttgtga

SEQ ID NO: 21180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggggactcactgagcggtagtctgacg

SEQ ID NO: 21181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggggatcgctcaccggtcgtgacttgg

SEQ ID NO: 21182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggggtgagtgtggtgcgccgatgctctt

SEQ ID NO: 21183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggggtgttgaacgcgttggtgacatacg

SEQ ID NO: 21184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggtcaactcggcgtacggaacgacctt

SEQ ID NO: 21185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggtgagtgccctcgagacgtgggctgt

SEQ ID NO: 21186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggtgtcggctcttcttagtcgggtgtc

SEQ ID NO: 21187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggggttggggataccgttgttcgacgggc

SEQ ID NO: 21188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtaaagtttttgtgtggtgtttaatgc

SEQ ID NO: 21189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtaacaggggtgcgcacaattggacgg

SEQ ID NO: 21190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtaccgtgatacagggggtatctataa

SEQ ID NO: 21191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtcagtcaggcaccccgaaccggtcac

SEQ ID NO: 21192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtctacagtgctggaaacgagcaatac

SEQ ID NO: 21193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtctgtgctttcgtagcgtccttacgc

SEQ ID NO: 21194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtctttgcgatgctcatgcgctcactt

SEQ ID NO: 21195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggtgactggagttaggggttcttggtgt

SEQ ID NO: 21196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggttggcgaggagttcaatcttagacgt

SEQ ID NO: 21197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgggttgtcggagtccgtgttcgctgtttc

SEQ ID NO: 21198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtaaccggtacactagcgtcgaggtgta

SEQ ID NO: 21199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtaccatggatttgttgcgcactggtat

SEQ ID NO: 21200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtacggctcacatgctggtccgtcatga

SEQ ID NO: 21201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtactggaggtgggcgtatttgtactac

SEQ ID NO: 21202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtagcgtttagtttagcccaggtcgttt

SEQ ID NO: 21203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtaggcagctcacactatcagcagcgcg

SEQ ID NO: 21204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtatgtatggtcctagtccgctttgtgg

SEQ ID NO: 21205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcatgctactgttggcgctttccgtct

SEQ ID NO: 21206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtccgttcacctttgctgatcagcttcg

SEQ ID NO: 21207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgcacaagcacgagtagactgaagtt

SEQ ID NO: 21208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgcatagtatgcttggttagaaaaag

SEQ ID NO: 21209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgcatgcagactttttcgcacggctt

SEQ ID NO: 21210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgccggataggctagttttggggtgg

SEQ ID NO: 21211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgctgatgggtgattagagatgtcgc

SEQ ID NO: 21212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtcgtgcaagtcgcgcaaaggtattatg

SEQ ID NO: 21213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtctgataggatccccggaggcgcctcg

SEQ ID NO: 21214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgacaacgagcggcgctccccaagtga

SEQ ID NO: 21215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgacagacccttgagcattggatcacg

SEQ ID NO: 21216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgaccgcttacctgtttctgtgctgta

SEQ ID NO: 21217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgacctctggcggggcactttacggcg

SEQ ID NO: 21218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgagaggctcgagatgggtaatctagg

SEQ ID NO: 21219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgatcttagcatgaaccctgcggaccg

SEQ ID NO: 21220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgatgggcgccttctcgctaacggggc

SEQ ID NO: 21221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgcacgtgtaagtcgcctggtatggta

SEQ ID NO: 21222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgccctgaaagcgaagttgttctttgg

SEQ ID NO: 21223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgcgcaacgtcacacgtagttgtattc

SEQ ID NO: 21224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgcggaccctgttccattggtttgttc

SEQ ID NO: 21225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtggagtctctcggggttcgcgatgtgg

SEQ ID NO: 21226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtggcgtcaggtttgccaatactctgcg

SEQ ID NO: 21227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgtcctaattgtgccatttgagtttcg

SEQ ID NO: 21228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtgttacttcagttcttaaccggtctcg

SEQ ID NO: 21229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttaatcctgggttcttcgagcgcccgg

SEQ ID NO: 21230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttaggcttacggcgggattgtgtaccg

SEQ ID NO: 21231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttcgctagcagtgggttccagggcggc

SEQ ID NO: 21232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttctgggggttcttaacgccagcgcgc

SEQ ID NO: 21233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttggagcgatatttcacctgggcgccc

SEQ ID NO: 21234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggttgtgcggcggtctttccgagcgtatt

SEQ ID NO: 21235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccggtttgtttcgggtgaccggtgtgcttgg

SEQ ID NO: 21236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaaacaccccaatctcgctggcgcgcta

SEQ ID NO: 21237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaaacaggctcttactgatgattcattg

SEQ ID NO: 21238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaaactcagctaataccggaagcggcgt

SEQ ID NO: 21239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaacttggagcacctgggttctcgacac

SEQ ID NO: 21240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaagaagtggacgcccgcagggggttat

SEQ ID NO: 21241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaagagtagctctacttctcggtctcgg

SEQ ID NO: 21242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaagcgagagctacgtagatccgtgtcg

SEQ ID NO: 21243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaagtatcgctgcccttgtctgcacccc

SEQ ID NO: 21244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaagtcaattgggcttcgtacttgacat

SEQ ID NO: 21245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacacccgttcgtgcatgcaatcccctc

SEQ ID NO: 21246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacagcatagcatttggcacagtcgcca

SEQ ID NO: 21247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaccggcgtgctattcgaaactacgcgg

SEQ ID NO: 21248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacgaacccccgcgatggaggaaaggcc

SEQ ID NO: 21249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacgcacgaccttattaatcaatccgag

SEQ ID NO: 21250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacgccacactggctgattggttcgagc

SEQ ID NO: 21251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacgctaaccctcatagccccggcattc

SEQ ID NO: 21252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtacgtggcttgtcttttgtggcgccatt

SEQ ID NO: 21253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtactctgaaatataagcgttacagcgac

SEQ ID NO: 21254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtactgtgtgttagagttagttagttggc

SEQ ID NO: 21255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagaatgagagtggcatctggtctgagc

SEQ ID NO: 21256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagacccggcaatcggtaagcgccgttg

SEQ ID NO: 21257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagcaagggctcgttcgggctgtatgcg

SEQ ID NO: 21258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagcaatacacctcaatgagctcctggg

SEQ ID NO: 21259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagcttgggtgtatttataccagtagta

SEQ ID NO: 21260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtaggagccgtgttggacgttgagccttg

SEQ ID NO: 21261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagtagacacgtttgcacaagatgtatt

SEQ ID NO: 21262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtagtttgtggtagggtagtgaagcttac

SEQ ID NO: 21263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtataacgtcgtccagcgatgccatgttt

SEQ ID NO: 21264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtatcatagagttatattgtgtgggcgag

SEQ ID NO: 21265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtatgctgcgtgactttatctgtgtcgcc

SEQ ID NO: 21266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcaagcgctgtacgtgtggagcgtcagt

SEQ ID NO: 21267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcacagtttcgcgcgtgtaatggatgcg

SEQ ID NO: 21268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcactctccctacacttatgagttccca

SEQ ID NO: 21269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcatcacgacataccttatgctctgcac

SEQ ID NO: 21270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcatctggacatcgtgtggcattagaac

SEQ ID NO: 21271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcatgtggacagttcttcgccttgagtc

SEQ ID NO: 21272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccaaggctcgaagcatggttgtagcgg

SEQ ID NO: 21273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccacacgtattatttttgtctgtttgt

SEQ ID NO: 21274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccatgtagtgcgcgagttacgttatcc

SEQ ID NO: 21275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccgtaagttggccgcacctcgttacgc

SEQ ID NO: 21276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccgtagtaacggatatacggatgtcat

SEQ ID NO: 21277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccgttcattacacaaggggcatacctc

SEQ ID NO: 21278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtccgttgatggaccgaatcctgtcgcgt

SEQ ID NO: 21279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcctaggatacatggtaaaccttgttgg

SEQ ID NO: 21280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcgaagcccgcacgaaccggtgttgagg

SEQ ID NO: 21281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcgagattaaggtgaatcggtcgctgca

SEQ ID NO: 21282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcgaggattgtgccctctccgtggtctc

SEQ ID NO: 21283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcggcttggcaatcatgaggctccgtgt

SEQ ID NO: 21284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtcgtcagatcgcctttacgggaatccgg

SEQ ID NO: 21285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtctaacggaccggttgaccataagtgcg

SEQ ID NO: 21286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtctccttgaccagtccgcttgtgaaccg

SEQ ID NO: 21287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtctggaatgagcttttcctgcgggttgg

SEQ ID NO: 21288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtctgtagcgcatttatgtgggacgctta

SEQ ID NO: 21289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgaaaagcgatgcgaaatttcctatgca

SEQ ID NO: 21290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgaaacatgttggcatgcacaggatttc

SEQ ID NO: 21291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgaagactgactgtgtttcggccatctt

SEQ ID NO: 21292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgacataacggttagatatggctccccc

SEQ ID NO: 21293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgacgcgccctctactcgggactgatac

SEQ ID NO: 21294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgacggtaatcttcctaagtcagctggt

SEQ ID NO: 21295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgagggattctcaatatgctagacaccg

SEQ ID NO: 21296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgatacagacgcaaatgcgggtttggcc

SEQ ID NO: 21297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgatcctcgttcgcagcagtaaaagggg

SEQ ID NO: 21298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgatctcctgactcgctttgtggtatgg

SEQ ID NO: 21299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcaatcgcagctcggtctgaagctaga

SEQ ID NO: 21300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcatgcatcgttaccgactccctcagc

SEQ ID NO: 21301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcatgctttacagtgatgaccgccctc

SEQ ID NO: 21302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgccatgactctattcgccatacgatgt

SEQ ID NO: 21303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcgaactcgtcccaaaatctacctggg

SEQ ID NO: 21304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgctaacctgtagtccctgatcatatag

SEQ ID NO: 21305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgctggcagatatgatggggcactcgtc

SEQ ID NO: 21306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcttcgtgatctggcgaataacctggt

SEQ ID NO: 21307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcttttatcaccgagtgcggacggaag

SEQ ID NO: 21308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgcttttcttggtgggtgcagtttcggt

SEQ ID NO: 21309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggcacttgcagattgctatcatgtcgg

SEQ ID NO: 21310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggcagcgctgttgctataccgggctgg

SEQ ID NO: 21311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggctcaacagcagtcagacagcaacgg

SEQ ID NO: 21312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggcttggaggcgtccattcgtgttgcg

SEQ ID NO: 21313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgggtaagcttggtggaggtcaaccggc

SEQ ID NO: 21314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggtatgttacagagatgctcgaggtgc

SEQ ID NO: 21315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggtgcagtccgtgttgctttgttgata

SEQ ID NO: 21316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggtggctgttgtatggatacaggtgtg

SEQ ID NO: 21317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtggtggtggtggaaagagtagcccgttt

SEQ ID NO: 21318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtagagaaggtgatttcccaactccga

SEQ ID NO: 21319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtaggatagtcggcaagtcgcgacggt

SEQ ID NO: 21320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtccgaattcaatttgttccacctgtc

SEQ ID NO: 21321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtctggcgtccggcgtgatccgtgttc

SEQ ID NO: 21322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtgtcaggatttatgaggctcgagtct

SEQ ID NO: 21323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgttggctgctcccatggttagcccttt

SEQ ID NO: 21324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtttgagagtttgcggagtatctcgtg

SEQ ID NO: 21325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtgtttggagtttctgttgacatgtggtg

SEQ ID NO: 21326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttaagcaatctcagccggataacgcggt

SEQ ID NO: 21327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttaccataatgtcaatgcaaaggacgcc

SEQ ID NO: 21328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttacttttgagctccgaagctaggcggc

SEQ ID NO: 21329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttatctggcgtgatcctcggttgtccgt

SEQ ID NO: 21330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcactacgttgtttctagtgtccatac

SEQ ID NO: 21331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcactctcacagtgtatgctcatatcc

SEQ ID NO: 21332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcagcgcagccagggcgatggggcgta

SEQ ID NO: 21333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcagggagtgcgcttcagtacagacgc

SEQ ID NO: 21334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcatcccgcctcgcttgtccgaactgt

SEQ ID NO: 21335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttccagcaaaatggcacagtcttcttgc

SEQ ID NO: 21336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcccgaggaatgtgaggctagtttata

SEQ ID NO: 21337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcctgatattcgacgaataatcttggg

SEQ ID NO: 21338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcgactagcattttacatttgcgtaac

SEQ ID NO: 21339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcgggtcggaacctctgtctggtgcga

SEQ ID NO: 21340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcggtgggtaaatagccaggccaggtt

SEQ ID NO: 21341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttcgtttgtgaacctcctctccgtagtt

SEQ ID NO: 21342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttctccttgttgtagtggacccctttgt

SEQ ID NO: 21343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttctgcgcgtgacctgaactggatcctc

SEQ ID NO: 21344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgacatttcctacactacctggcttct

SEQ ID NO: 21345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgactgatacatgtgattccatcgcca

SEQ ID NO: 21346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgagataccgatattccactccctgca

SEQ ID NO: 21347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgatactgtgcaactcacggcgcagat

SEQ ID NO: 21348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgcagaggaagtgcagagccgggttcc

SEQ ID NO: 21349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgccaccaattcgtcagggcgggggtg

SEQ ID NO: 21350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgcgtactcgctctgtgttcgtacgta

SEQ ID NO: 21351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttggactgtggcggctgactgtcatatg

SEQ ID NO: 21352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttgtaggctccaaggtgaaccctctcac

SEQ ID NO: 21353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtttagagggtgtaacgactcggtgatcg

SEQ ID NO: 21354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtttcagcaacctccgaccacgctggagc

SEQ ID NO: 21355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtttccggagaattatttggtaccatggc

SEQ ID NO: 21356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtttggcccaaattaacgtcgtaggcaaa

SEQ ID NO: 21357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgtttggtactgaacgtatagcttcatcgt

SEQ ID NO: 21358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttttattggtacaacctggattgcatgt

SEQ ID NO: 21359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccgttttgcattcccagtcaacgtttcgtgt

SEQ ID NO: 21360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaaatggttagtcattcagagagtgcggg

SEQ ID NO: 21361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaacaatgatcatagcgatttccacgtac

SEQ ID NO: 21362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaacacccctgtcgatccctaggaaggat

SEQ ID NO: 21363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaacctcctgctgtcaatcgccaccagcc

SEQ ID NO: 21364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaacgtggaactaaagtcttaaagccagg

SEQ ID NO: 21365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaacttcgacgcgcaaataggcacacgac

SEQ ID NO: 21366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaagctcaggacagggtgactcgtatgtg

SEQ ID NO: 21367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaaggttccgtacctagaaactgcatttg

SEQ ID NO: 21368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaatcctgagcgcaacaactgtccacacc

SEQ ID NO: 21369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaatgagacgtgcgtcccggcctcatcta

SEQ ID NO: 21370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacagggtcgtaatgatacaaaagcacgg

SEQ ID NO: 21371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacagtattaatttgttccagttccttca

SEQ ID NO: 21372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacccgacttggtgagttcacccgaccgg

SEQ ID NO: 21373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacccgctctgtgcctggtatctagggag

SEQ ID NO: 21374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaccctgaagttggcgagcgattaggacc

SEQ ID NO: 21375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacctcctcgctgatcccgccttgaggtc

SEQ ID NO: 21376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacgacccatcgcgtacactccggaccaa

SEQ ID NO: 21377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctactaggctttactcgcctgtgattcgtc

SEQ ID NO: 21378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacttctttgtagtctggaacactctggt

SEQ ID NO: 21379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctacttgcgcacacacccttcccgtcaatg

SEQ ID NO: 21380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagaaaagttcttaggtcaaccgtacctc

SEQ ID NO: 21381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagaaccggcgttcggagagtatcacgta

SEQ ID NO: 21382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagatctagcctgagggaaatcaattgtg

SEQ ID NO: 21383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagcacatcgaaccgtcccctgtggtaga

SEQ ID NO: 21384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagccattgcgtgagacgtcacaacccac

SEQ ID NO: 21385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggacagatcccaaacccggttagtgtc

SEQ ID NO: 21386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggattttcggcgtgcacccagttgccc

SEQ ID NO: 21387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggcaagctcgaatacacgtcgtatatt

SEQ ID NO: 21388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggcatctctgtacactaacggatagct

SEQ ID NO: 21389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagggaaagagcacacgcagtggttacgt

SEQ ID NO: 21390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagggaagattctgatccgctatcgagct

SEQ ID NO: 21391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagggctgctacgtgacagctgcgacaaa

SEQ ID NO: 21392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagggggttgcttagtaaaatatttgcac

SEQ ID NO: 21393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagggtcttgatacgtaggccatttattg

SEQ ID NO: 21394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggtcattcacacgggggaggtagatac

SEQ ID NO: 21395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctaggtcgccctctgacaggatcgaatttg

SEQ ID NO: 21396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagtccagcacgcgctagttgtactctgt

SEQ ID NO: 21397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagtgtaagagatcgcgcgccttaacacg

SEQ ID NO: 21398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctagtgtgtgcaggtatcaactacgtggtg

SEQ ID NO: 21399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatacagactcggctccgcgccgggcgca

SEQ ID NO: 21400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatagccgtagtctctacgccgcgacttg

SEQ ID NO: 21401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatattagggtagtttcccgatggctttc

SEQ ID NO: 21402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatcaagatggagctccactgcctcagcg

SEQ ID NO: 21403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatcaatgtgtgaaccggcgcaggcatgg

SEQ ID NO: 21404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatcagttgcccgctgtgacctcgcccgg

SEQ ID NO: 21405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatccgaatgagatgtaatgcgttcgaga

SEQ ID NO: 21406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatcgttggaaaacctgattacgcgaacg

SEQ ID NO: 21407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatctgggttcattggcactttgatcaga

SEQ ID NO: 21408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgagtcctgcggtagtcgtgtccactc

SEQ ID NO: 21409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgccaaactgaaacaatcgcgtaagca

SEQ ID NO: 21410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgctggtgctgaacttgcttacctcgc

SEQ ID NO: 21411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatggaaggtggtgggaccggtggcgcgc

SEQ ID NO: 21412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatggctcggtatccatgtggcgttctag

SEQ ID NO: 21413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatggtggtacacgctctctgatttcgtg

SEQ ID NO: 21414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgtacgaccagcttccctccagagatt

SEQ ID NO: 21415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgtactggctttagattaaacctcgcg

SEQ ID NO: 21416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgtcggattatggctcgaagcacagtt

SEQ ID NO: 21417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgtgatacgatcggcccgttgcgaata

SEQ ID NO: 21418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctatgttccatcttcacctctgtttgtgca

SEQ ID NO: 21419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctattggtcgtagttggttgcgtctttcgt

SEQ ID NO: 21420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcaaagcattcttttgccatgcgcgcggg

SEQ ID NO: 21421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcaagaaaggagcgtataagtggctgaca

SEQ ID NO: 21422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcaagcatgtccgatacatgtccatatgt

SEQ ID NO: 21423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcaatcagtaactacatcttttctaacaa

SEQ ID NO: 21424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcaatccgtcgcgttcccaggttcacccc

SEQ ID NO: 21425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcacgacgactaaatcacttctactctga

SEQ ID NO: 21426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcacgagacaggcgtcccaatttgtgcga

SEQ ID NO: 21427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcacgtatccctaatccacggagagctcc

SEQ ID NO: 21428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcactcttgttgcatcccttcaggattct

SEQ ID NO: 21429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcactgtcgcgatgcagaatgtccttctc

SEQ ID NO: 21430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcagagctttaggtaggccgttgcgcggt

SEQ ID NO: 21431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcagatagtcctgcacgatcgtgcacggg

SEQ ID NO: 21432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcagatggtcccgggtggcacatgtgctc

SEQ ID NO: 21433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcagcctaggggacgaatcctccaggcgc

SEQ ID NO: 21434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcagtgcgttgaaatgcagggttacacca

SEQ ID NO: 21435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcatagcactggggctcaagacgtggcgg

SEQ ID NO: 21436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcatgaggaggcaactaaggatttcggtc

SEQ ID NO: 21437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcatgcaacctcggggcaggcgttcacgt

SEQ ID NO: 21438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccacctctgtcacgtggaacttccagcg

SEQ ID NO: 21439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccacgggacagccaacgactatcgggag

SEQ ID NO: 21440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccatgtgctaagtcttcagtattctttc

SEQ ID NO: 21441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcccgatgttcaatcgtgccgagttccac

SEQ ID NO: 21442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcccgctagcttgcttgctaccatgtttg

SEQ ID NO: 21443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccctcctgcagccaacagccttaccatc

SEQ ID NO: 21444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccgaagcatcacgtggttaagccgggta

SEQ ID NO: 21445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccgcgaattagtttatggctcaagtttc

SEQ ID NO: 21446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccgcgctcagcaccgggtgggattcgat

SEQ ID NO: 21447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccgtccctttctgcacgtttcgtacgtt

SEQ ID NO: 21448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcctaaatttattgtaatgtgacgttcat

SEQ ID NO: 21449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcctcacggctgtagggacctttggttag

SEQ ID NO: 21450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccttacacaacgcgtttcctcatcagcc

SEQ ID NO: 21451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccttcagtggttgaaccacgaagatttg

SEQ ID NO: 21452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccttctccggtgtccaaagtgtcgaggt

SEQ ID NO: 21453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctccttctttcatcttgtccccgcctcgac

SEQ ID NO: 21454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcctttattttgcagctttcttattagtt

SEQ ID NO: 21455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgaacccgggctcataatgcttggacga

SEQ ID NO: 21456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgaccagttctggcacgccgcaaattag

SEQ ID NO: 21457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgagcgatcgctgatcacggtgttgtgg

SEQ ID NO: 21458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgatagagtgcgtgaaggcatgccgtct

SEQ ID NO: 21459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgatagattgccgcgagcgcgttcccgt

SEQ ID NO: 21460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgattgcgactccataacgggcatcaac

SEQ ID NO: 21461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgcatctagcttgtctgtatgtctggat

SEQ ID NO: 21462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgcatggctatatttgcataatactttg

SEQ ID NO: 21463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgcatttcgggttgtcgttgcggtgtgt

SEQ ID NO: 21464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgccaagcgatattgcaccttcgggatt

SEQ ID NO: 21465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgccattcattccctaagtaagatgttt

SEQ ID NO: 21466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgcgaggctgtaacttgtttaacaaagc

SEQ ID NO: 21467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgcgtctttatggattgctagactttcg

SEQ ID NO: 21468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgctgcaactgcgtcaagttctgcatac

SEQ ID NO: 21469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgctttgaaaacgaaggtaaggggagac

SEQ ID NO: 21470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggagctcagcttcccactgctttttcg

SEQ ID NO: 21471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggaggaacaggttggtgtttccgtccc

SEQ ID NO: 21472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggcgacgtactgctctaacctggccgt

SEQ ID NO: 21473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggctctcgcgtgcgttccttgttcccc

SEQ ID NO: 21474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggggagcttgcgcttcatgttccgttg

SEQ ID NO: 21475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggtaaagaaggtgataaaccgttggtt

SEQ ID NO: 21476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggtaaggtgaccgatgtgtacagcgtc

SEQ ID NO: 21477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggtaggtggcttgttgtgttcacaggc

SEQ ID NO: 21478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggtcgttccctccgaacacgctcgctc

SEQ ID NO: 21479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggtgcccccgctgagagggtggggtat

SEQ ID NO: 21480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggttacttgtgtcacccccgccgatcg

SEQ ID NO: 21481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcggttgtgctttgattgttcaatagggg

SEQ ID NO: 21482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtcaattcttctcagcacgacggaagg

SEQ ID NO: 21483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtcggtcgcactatttcgggttgcatc

SEQ ID NO: 21484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtctctaagctaccacactaaccaagc

SEQ ID NO: 21485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtgattagcggtcgtccctgctgaatg

SEQ ID NO: 21486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtgcgcaaagaagcggcattagtcggg

SEQ ID NO: 21487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcgtggtgctcgaacatgtcgtttctctc

SEQ ID NO: 21488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctaaccagactcccttatcaaccctctg

SEQ ID NO: 21489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctagtactgactcaatcttcgaggtggt

SEQ ID NO: 21490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctatcccaacgtctagggttccatgagt

SEQ ID NO: 21491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctatgaaattgaaaaaacgtctgtcacg

SEQ ID NO: 21492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctatttgggagcagccgggctgtatcaa

SEQ ID NO: 21493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctcccgttacattgcaactgaactaatc

SEQ ID NO: 21494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctccgattccattgcacacgtaggccgg

SEQ ID NO: 21495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctcgacacgcgaacggcggatcgagcaa

SEQ ID NO: 21496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctcgcaagcccctagtgatacgatggtt

SEQ ID NO: 21497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctcgcgaacgagattagaccccgtgggc

SEQ ID NO: 21498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctcgcgaactcacgatccaacaactgct

SEQ ID NO: 21499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctgtggagcggagccacaagacgctctc

SEQ ID NO: 21500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcttatgacagggttgactcgaggcattg

SEQ ID NO: 21501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcttcaactgagttcaaagcaccaaagta

SEQ ID NO: 21502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctctttggtgctaaggatgtcaagcatgtc

SEQ ID NO: 21503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctcttttggcctctgtacggctggaggttc

SEQ ID NO: 21504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaaacgactagcagataccagcttggaa

SEQ ID NO: 21505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaaacgactctgcatacgttgtcacgtg

SEQ ID NO: 21506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaaccagccggtgatgtcactgcatcgg

SEQ ID NO: 21507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaacttacgtagaggctaccgtatcggg

SEQ ID NO: 21508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgacaaaacgatacaggacgcgactgatc

SEQ ID NO: 21509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaccaagcctggtaatatgctcattgcg

SEQ ID NO: 21510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaccaatgtgtaagttaggagggacccc

SEQ ID NO: 21511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaccccatggtgacttcactaaacactg

SEQ ID NO: 21512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgacgctgactactagcatatgtgtcggg

SEQ ID NO: 21513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgacgcttgttccacagagtttgggagcg

SEQ ID NO: 21514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgacgtatttactgatattgtgcgtttct

SEQ ID NO: 21515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgacgttggtgatatttatatggttttga

SEQ ID NO: 21516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgagcgttgaagtggctaccggtcccgca

SEQ ID NO: 21517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgagcttgcaacaaacatgtctgaacccg

SEQ ID NO: 21518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgagggtggggaagcgtggcgatgcgaca

SEQ ID NO: 21519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgaggtcggccgtcgagatttctgttcta

SEQ ID NO: 21520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgagtacgcctagtgtccttcaatggctc

SEQ ID NO: 21521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgagttacttgatggacgtttctagattg

SEQ ID NO: 21522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgatctcgacgtggttttggatctacgtg

SEQ ID NO: 21523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgatgaccccagctacctctcacgggtat

SEQ ID NO: 21524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgattcctactgacttaaagaccgcgtgg

SEQ ID NO: 21525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgattggacgcgaatacgaatggcctggc

SEQ ID NO: 21526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgatttaacgggcggcggcattaacacct

SEQ ID NO: 21527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcaaatatccgacgtattaccgcgttgc

SEQ ID NO: 21528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcaagttatgatggtcacaggtttggaa

SEQ ID NO: 21529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcaatccagtccatcatagtcgcatcgt

SEQ ID NO: 21530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcagagcgtgagtattatgagcggctct

SEQ ID NO: 21531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcagtggtcggtggaaaagaccttctgg

SEQ ID NO: 21532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcatacaaatgcttggtcgttagttccc

SEQ ID NO: 21533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcatacatgatccgggacgagggacatt

SEQ ID NO: 21534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcatttcgattccgtgagcttatgcact

SEQ ID NO: 21535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccaaatggtcgctttcctttgtatgcg

SEQ ID NO: 21536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccacattcttgagaggattccgccacc

SEQ ID NO: 21537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccatcgtgcgtgaggatctgcatatgg

SEQ ID NO: 21538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcccaccctcatgaatgtgtatcaaacg

SEQ ID NO: 21539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcccaggtaaggccagaaaggggtgccg

SEQ ID NO: 21540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccctccgcgaaactggcgagtagatct

SEQ ID NO: 21541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccgacacgtgtcataccgcatggggcc

SEQ ID NO: 21542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccgccggttcacagacatgggactgtg

SEQ ID NO: 21543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgccggttccttctttgcttggtacacgg

SEQ ID NO: 21544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgactcatccggtggttactggcggtg

SEQ ID NO: 21545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgagtcgaacggattgtgcgcggtgtt

SEQ ID NO: 21546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgccagttaccgtgattcgggccaggg

SEQ ID NO: 21547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgcgaatgagtgtatcccccacagtct

SEQ ID NO: 21548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgtatgtgcaccgttggtatctctgtg

SEQ ID NO: 21549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgtctcacgtgtcacgcatttgtaggg

SEQ ID NO: 21550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgcgtctttacccgaccccgctagttgga

SEQ ID NO: 21551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgctaacgtcaacagcgttaatgggactc

SEQ ID NO: 21552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgctacctaaccatcaacccaagatggca

SEQ ID NO: 21553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgctaggattagtaacatgcaaattggca

SEQ ID NO: 21554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgctcaatgatccgattgttaagggaatc

SEQ ID NO: 21555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggatcggcgcgagtgtgctggacttgat

SEQ ID NO: 21556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggattccctgtcgtgtgacccggtcccg

SEQ ID NO: 21557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcagattctgcgtaactattgatggag

SEQ ID NO: 21558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcatggccgacattcgctggtcctata

SEQ ID NO: 21559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcccacccctgctggagcaattcgacg

SEQ ID NO: 21560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcccagcgtgtctgcgttgcgctgcgc

SEQ ID NO: 21561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcgctttatacgttgcgtcctagttcc

SEQ ID NO: 21562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcggatatccagtattgcgatcaagtg

SEQ ID NO: 21563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcggattaataaccggatggttaatac

SEQ ID NO: 21564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggctatttggatttggatctgtgtctaa

SEQ ID NO: 21565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggctcattgaaacgttttgttcttctac

SEQ ID NO: 21566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggctgcttcatggaattaactgcttaca

SEQ ID NO: 21567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggcttcccgcttcgtgtatgtatgaacg

SEQ ID NO: 21568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggacatctgccgactaggtctggggta

SEQ ID NO: 21569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggaggccgcactcgcgtgttcggtcct

SEQ ID NO: 21570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggatcgtccacagctccggtgcacggg

SEQ ID NO: 21571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggccgctcttagctggttctacacgcg

SEQ ID NO: 21572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggcgtatccggtctgtctcctaggcgg

SEQ ID NO: 21573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggctcataaagcgcactcaccggtggg

SEQ ID NO: 21574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggggaggctttttacatcgatggtgttt

SEQ ID NO: 21575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggtagctttgcgtatgcggctcgttgc

SEQ ID NO: 21576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgggtggtgtacacgtgctattaacctat

SEQ ID NO: 21577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtaatgagtggtgttcatgtcagagca

SEQ ID NO: 21578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtagctaaggtttcctgcctttccggt

SEQ ID NO: 21579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtccatgaggggattatctcggagtag

SEQ ID NO: 21580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtgtacaagaccgcccagttcacaatg

SEQ ID NO: 21581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggttcagtcaggttgtcacagtactttg

SEQ ID NO: 21582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtttattgttaattataccggcgacgt

SEQ ID NO: 21583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctggtttgggtaagttgcgcgtaagattcc

SEQ ID NO: 21584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtacagcgcttgggtatttctcatgccc

SEQ ID NO: 21585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtaggcaaggccgctggtggtcgtccac

SEQ ID NO: 21586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtcactccaagcgcggctaaatcacttc

SEQ ID NO: 21587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtcgctggttttgtgccctatactgtgc

SEQ ID NO: 21588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgacaacccgcccctcgatggtccgtc

SEQ ID NO: 21589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgcagcccgcggtagctccttgttcgg

SEQ ID NO: 21590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgcggtgttcagcttcggttatttcgt

SEQ ID NO: 21591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtggaggaggtaggtttcacacctgggt

SEQ ID NO: 21592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtggtacaaatactcacgtcccgtccca

SEQ ID NO: 21593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgtcatgggcagtcgtttggaacgagg

SEQ ID NO: 21594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgtcctaggcggtgttagatgtcggcc

SEQ ID NO: 21595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgtccttccttgcatcgggtagcgtgc

SEQ ID NO: 21596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtgtcgggttgagccaccctgtaggctt

SEQ ID NO: 21597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgttaggatatagtttatacagtccggct

SEQ ID NO: 21598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgttctgggctggtctttgtcacgagcaa

SEQ ID NO: 21599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgttgtatgtagggcggcattggcatctc

SEQ ID NO: 21600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgttgtgcatgattgccggcacgggaggc

SEQ ID NO: 21601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgttgtgcccgttgctggagtagagggag

SEQ ID NO: 21602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctgtttgtagggtcgaaagaacatcccctg

SEQ ID NO: 21603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaaaacggaatcgcgactcttttgctga

SEQ ID NO: 21604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaaaggttccacttgactatggcagtcg

SEQ ID NO: 21605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaacctagttagttctacattccactgc

SEQ ID NO: 21606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaactcgctttgccttgtggttaggcat

SEQ ID NO: 21607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaaggactgttaggcatgtcacgccgga

SEQ ID NO: 21608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaagtagccatggttctctgacgttgcg

SEQ ID NO: 21609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaccggacttcgctcccagttcgttgga

SEQ ID NO: 21610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttacgatctggtagttactgggctcagcg

SEQ ID NO: 21611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttacgcccgattcctttatgtggcaccca

SEQ ID NO: 21612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttacgtaggccaaccagctcgagctagaa

SEQ ID NO: 21613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttacgtgtctgaagttttatgcccactgc

SEQ ID NO: 21614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttacttgagtacccggtaccgcgtcctag

SEQ ID NO: 21615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttagcgtacactctgagtgacgactattt

SEQ ID NO: 21616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttaggcattgcaccgactattcggtttgt

SEQ ID NO: 21617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttatccttacgttgccagaatcccgcgtg

SEQ ID NO: 21618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttatcgtcggagtcaaccttttgttcctc

SEQ ID NO: 21619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcaagccgcttttgctgctatgcgactc

SEQ ID NO: 21620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcacaccacttttaatacccgcgatatt

SEQ ID NO: 21621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcacatttgagtcaccgtcttgctctct

SEQ ID NO: 21622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcaggttgttgattcaggcgtattaccg

SEQ ID NO: 21623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcagtcttgggacgtgagaactgggtca

SEQ ID NO: 21624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcatcacttcacgcactgttaggccatc

SEQ ID NO: 21625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcatcgcggtgtccggagtcgacaggcc

SEQ ID NO: 21626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttccaacgcagggaagtgcagtcgccctg

SEQ ID NO: 21627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttccacataagaacttcgcatgtgttcgg

SEQ ID NO: 21628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttccacttccgggttcgcgacgctcgatc

SEQ ID NO: 21629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttccccgtctgaaaggatcacggatggga

SEQ ID NO: 21630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttccctggtactggcactatcagcgtgtt

SEQ ID NO: 21631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcctgtacgggtaatgcaattctctgta

SEQ ID NO: 21632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcgagtctacccttctcccggccgggtg

SEQ ID NO: 21633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcgatttacatgaatccaggtttaggcg

SEQ ID NO: 21634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcgcccatctcgtgtggtcctttgatcc

SEQ ID NO: 21635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcgtcggctggattcggatgtcggctgg

SEQ ID NO: 21636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttcgtggcgcaacctgatgttgtgcgtgg

SEQ ID NO: 21637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttctaatgtcagtattggtagctaacgga

SEQ ID NO: 21638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttctgttacgggagtagtcttaggccatt

SEQ ID NO: 21639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgacgcagcccagctggatttgaatgtg

SEQ ID NO: 21640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgattgcctggtttgggttcaccatcgt

SEQ ID NO: 21641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgctgcgaacaatcgatgctgagtaggc

SEQ ID NO: 21642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgcttcccaagatagaactgtcaattcc

SEQ ID NO: 21643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgcttgttaagtcgtgcaggtatcgggt

SEQ ID NO: 21644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgctttgactccctgtttaattatctgc

SEQ ID NO: 21645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttggagcattgagagatctttcgcaaatg

SEQ ID NO: 21646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttggcatctgcggtgctcgcttggggtgc

SEQ ID NO: 21647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttggctccctcgtgcgcaaaactcagaga

SEQ ID NO: 21648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttggctgttaatctccgcgttattctctg

SEQ ID NO: 21649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgggctcgccgcaggcggtgttttactc

SEQ ID NO: 21650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgtctacgcaattagcaaggcccgttgc

SEQ ID NO: 21651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgtggaagcacctcaacaatgctggtag

SEQ ID NO: 21652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttgtggtgggccaaaacatggtcgagata

SEQ ID NO: 21653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttaagtaccagtgggtcgccgacgagga

SEQ ID NO: 21654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttaccctgttcttgtgttcgcgcgacta

SEQ ID NO: 21655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttactcggcaggtttagcaagacacaat

SEQ ID NO: 21656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttcattgaagtccgaagggtccagctca

SEQ ID NO: 21657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttcccctcaagcagtcgggtacagtttg

SEQ ID NO: 21658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttcgagtaccaattggtggtgacggtgg

SEQ ID NO: 21659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttcggatggcggtgctttcttgaggttt

SEQ ID NO: 21660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttctagtacttaaatgttgaaatcattg

SEQ ID NO: 21661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttgcagaccgtaggggattgtgggtgat

SEQ ID NO: 21662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttgcctctttggggtttacgccccgtag

SEQ ID NO: 21663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttgcgacgtccgagtcttacagctactt

SEQ ID NO: 21664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttggacaattgtctgccgtcgcctactt

SEQ ID NO: 21665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttggattgcaatgtgtactggcttctgt

SEQ ID NO: 21666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttggggaatgatcgacttaggcgtgagg

SEQ ID NO: 21667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttgtgttcccgtgggaactttagcgagt

SEQ ID NO: 21668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccctttgttcccagacatgctcgtcgttcgct

SEQ ID NO: 21669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttttcaaggatgtattactcatccgactg

SEQ ID NO: 21670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cccttttcttgtgtatgttagccgcagcaccc

SEQ ID NO: 21671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaacaccacaatcgggtgcggacagcgt

SEQ ID NO: 21672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaaggggattgttcatgcccccgtgtcc

SEQ ID NO: 21673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaagtgtggtatcagggctaatggtatt

SEQ ID NO: 21674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaatccacccctggaacgatacccgcgg

SEQ ID NO: 21675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaattacactaatattaggaggagcgca

SEQ ID NO: 21676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacaaccgcgtggggtgcatttgggatg

SEQ ID NO: 21677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacaatgtctactacatcgtttgatcac

SEQ ID NO: 21678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacacgcgacgagactgctcttccgacg

SEQ ID NO: 21679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacagtccttcccgcgggggttgatcgt

SEQ ID NO: 21680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacattcgaattgccgtcaattacgatg

SEQ ID NO: 21681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaccataacatagcctttgcgcacttgg

SEQ ID NO: 21682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacgggcttacccccattaatcgttctt

SEQ ID NO: 21683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaacggtcgtgggctggatgtgaaggctt

SEQ ID NO: 21684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaactgcagccaccgtgatcaaaattagg

SEQ ID NO: 21685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaagatcagtttacgccagttggtggcca

SEQ ID NO: 21686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaagcagagtctaatggaagtgatgcgtg

SEQ ID NO: 21687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaggacggtaccacattgtgctggcggt

SEQ ID NO: 21688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaggcggcaccaatggtttctggcgtgg

SEQ ID NO: 21689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaggcgtgtgcgacaacttatagcgccg

SEQ ID NO: 21690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaaggttctgttggtatgaaacggggtcg

SEQ ID NO: 21691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaagtagacgcgtagtaaactggagccgt

SEQ ID NO: 21692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaatataattacgctcgaaatctgtccgc

SEQ ID NO: 21693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaatcccgagacgtttcgcttagttactg

SEQ ID NO: 21694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaatctgcgctctgaacagccgcctggcc

SEQ ID NO: 21695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaatgtggatggcgcaacttgccgacccg

SEQ ID NO: 21696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacaacctgggaaccggcgactctcacgg

SEQ ID NO: 21697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacacctgacgcggcaagaccagggctca

SEQ ID NO: 21698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacactgtacgcgcgggctggttgcaaac

SEQ ID NO: 21699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacagagtggcagttagcttgcctccgtg

SEQ ID NO: 21700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacagttgtggatggagccgtccgaagcg

SEQ ID NO: 21701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacatcggtgaaagtatgtgggtacagtg

SEQ ID NO: 21702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaccaatccgagactaacgacggcgtgca

SEQ ID NO: 21703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaccgctaaggacgcttatgacctttatt

SEQ ID NO: 21704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaccttgtgagacaggaggcactttttcg

SEQ ID NO: 21705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgaaagcccgtccggttcgcgggagcc

SEQ ID NO: 21706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgaataattgagttgtgtgaatgattg

SEQ ID NO: 21707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgacaggtacaacgctcgtgtttccga

SEQ ID NO: 21708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgaggcgcggaatcttacttgatccta

SEQ ID NO: 21709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgcactcaggccagttagcgtaaacat

SEQ ID NO: 21710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacggaatcctgggtctgctgtgatgagg

SEQ ID NO: 21711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacggtagtctctagcggacttctcttat

SEQ ID NO: 21712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacggtggcaacccagcggctacgtgttc

SEQ ID NO: 21713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgtctggtcccaaggaggggactatct

SEQ ID NO: 21714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaacgtgtccggatgtgaaaggtgcggagc

SEQ ID NO: 21715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactcaacagtaggtgtcgggttgctgtc

SEQ ID NO: 21716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactcagtgctagtgtacacccggcgagc

SEQ ID NO: 21717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactccaactgaagagccctcgtctttcc

SEQ ID NO: 21718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactgacattgttggtacttgaatggctt

SEQ ID NO: 21719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactgagacaatctaatctggacaaaacg

SEQ ID NO: 21720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaactgtgcatgaagtgtgaagttttttgg

SEQ ID NO: 21721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagaagggggtcaccggccacacgcaggc

SEQ ID NO: 21722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagaatggtgaatacgggtagtacttctt

SEQ ID NO: 21723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagactggcacggaacgcctttcagttgg

SEQ ID NO: 21724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagaggaaggattgtggatatgcgcaacg

SEQ ID NO: 21725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagaggcgacgcccgtatgttgtgccgcg

SEQ ID NO: 21726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagaggggatcagggcggcccattcgtcg

SEQ ID NO: 21727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagatactgttggcgataagctggtactc

SEQ ID NO: 21728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagatgtcatgcgagtcccagggaacgcc

SEQ ID NO: 21729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagatgtggaacgcctcatacgccatgcc

SEQ ID NO: 21730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcagagtttaagacacgatagacattt

SEQ ID NO: 21731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcagcgggcgaccgtcttgttgcttta

SEQ ID NO: 21732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcatgcggaaaacttgcttttgactcc

SEQ ID NO: 21733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagccgactaagaccaacggtgtggcgag

SEQ ID NO: 21734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcgaccattctagcagtggtgacgtga

SEQ ID NO: 21735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcggaagccggtttgccccttgagcgt

SEQ ID NO: 21736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcggttgtggttggggccgggagggag

SEQ ID NO: 21737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagcgtgctaaacatttctgcgtttgcgg

SEQ ID NO: 21738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagctagacatgtggtccgcaagttcagg

SEQ ID NO: 21739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaggaccgaaaccatactttagtccggac

SEQ ID NO: 21740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaaggagccttggctatgtacgcgctccgg

SEQ ID NO: 21741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagggcgtcggcgtcttctatattacctt

SEQ ID NO: 21742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagtagaccagagccacttttcctgggtt

SEQ ID NO: 21743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagtccccacagtcggtatggatacgtcg

SEQ ID NO: 21744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagtcctctcgggacacaccgtgtcagta

SEQ ID NO: 21745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagtctgccaaaaggacggctgtactcga

SEQ ID NO: 21746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaagttcacgacgcagaattttagccgggc

SEQ ID NO: 21747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatacacctcattttcaactcttgccctc

SEQ ID NO: 21748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatagcgtcgacgtctcaagcggttggtg

SEQ ID NO: 21749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatagtgacggtgtcaccgtacctctgtg

SEQ ID NO: 21750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatagtggtcgacagtcattgacagaggg

SEQ ID NO: 21751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatatatatttcatcccattggcgcaggc

SEQ ID NO: 21752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatatttacgtgtaatccctttagacgct

SEQ ID NO: 21753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatcacctcagtcaacacgattagtgggt

SEQ ID NO: 21754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatcacgcagactaatgaatgctattgtc

SEQ ID NO: 21755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatccaatttccgtaattaatgtggatcc

SEQ ID NO: 21756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatcgggccgaaagttcaggaaggggggc

SEQ ID NO: 21757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatcgtcctctaatgcctttacgcggttg

SEQ ID NO: 21758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatctgtcctgcgcacgcacgggcaacca

SEQ ID NO: 21759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgagagctgggggttaggtggatcgta

SEQ ID NO: 21760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgatgacgtataagtacgcatgcgatt

SEQ ID NO: 21761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgcaggagcgggcatctaaccatgcgt

SEQ ID NO: 21762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgcaggttttcgccagtccacggccca

SEQ ID NO: 21763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgcgcttgacgggatcgttacgttagt

SEQ ID NO: 21764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatggagcgtagagtcaggactcgctcgt

SEQ ID NO: 21765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgtaagacgattagggcttaacttgca

SEQ ID NO: 21766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgtcgcgtttaactagttctgatcggc

SEQ ID NO: 21767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaatgtggtttggtcacgggcttgggcgga

SEQ ID NO: 21768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaattcatacttggtcacgcaggtaaggtc

SEQ ID NO: 21769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaattccccacgcccatgaattcaacgtct

SEQ ID NO: 21770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaattccgtcgcctccataccggggacacg

SEQ ID NO: 21771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaattgccccacatggagcttggtgaagcg

SEQ ID NO: 21772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaattgtcaatgacggtttcacagtggggt

SEQ ID NO: 21773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaaaccacggctactcctgcctctggtt

SEQ ID NO: 21774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaacacatggcaaggcaagctacaaccg

SEQ ID NO: 21775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaacccgcgctaactgatcccagtatat

SEQ ID NO: 21776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaaccgagctgggagtcatgccttgttc

SEQ ID NO: 21777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaacgacattccatcaagtattttcaat

SEQ ID NO: 21778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaataagtgcacttgcagatatcaggat

SEQ ID NO: 21779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacacagaccgtaagcggttgggttcacgg

SEQ ID NO: 21780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaccacgattcttgctcccccatgctgc

SEQ ID NO: 21781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaccattgctaaagtgcttaaacagccg

SEQ ID NO: 21782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaccgcgcccaatgtatgtacaccggga

SEQ ID NO: 21783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaccgtgtgtattgtgaccagttcgtgg

SEQ ID NO: 21784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacacgccagcttgccaatcagggtcaggg

SEQ ID NO: 21785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacacggggagggccactatcacttcgtag

SEQ ID NO: 21786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacacgtcgtatgatatccgtttgatagtt

SEQ ID NO: 21787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacactggcatatcgcgacttcatctccct

SEQ ID NO: 21788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacacttgcctacccctgccgggcaccacg

SEQ ID NO: 21789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacagacttccttgctcatggcactcccgt

SEQ ID NO: 21790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacagcccgtgtttactcaccgggggccgg

SEQ ID NO: 21791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaggcagagcgtggaatggtggctgatc

SEQ ID NO: 21792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacagggtctgctctgtgacgacacaaggt

SEQ ID NO: 21793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacaggtttcttgtcaagttgagggcggat

SEQ ID NO: 21794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacagtcgaatcgcaaccccgcgggagggc

SEQ ID NO: 21795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacagtcgtaggcgaaggaggtgtcgggtt

SEQ ID NO: 21796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacataattcattgacctgggttaagactt

SEQ ID NO: 21797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatacacaggggagcgggcgtttggcgg

SEQ ID NO: 21798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatagagccggagcccgctatatggtgt

SEQ ID NO: 21799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacataggtattacgaaaccatgagcctgg

SEQ ID NO: 21800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatcgggggcgtttgtgcttgtgaagcc

SEQ ID NO: 21801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatcgtttagggggcaaccgtgtaaata

SEQ ID NO: 21802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatgcaaggtgcaatctctggattatac

SEQ ID NO: 21803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatggagctattcatggaacatcgctta

SEQ ID NO: 21804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacatgtggggggcatagataagggtttgg

SEQ ID NO: 21805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacattacctgacgacaaccatttggattc

SEQ ID NO: 21806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccaaacagttaacataacagtcccgtca

SEQ ID NO: 21807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccaacgcatcgcaacccggacactacgg

SEQ ID NO: 21808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccaccttcatctgcactatcgggccccg

SEQ ID NO: 21809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccacgggatctggccgcgggctctcctt

SEQ ID NO: 21810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccactcggtggtgggggtgtacttatgg

SEQ ID NO: 21811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccactctacactaggtcgacaacactgt

SEQ ID NO: 21812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccagccggatcctagttttatgtggacg

SEQ ID NO: 21813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccaggactgccccagatatcgttagctc

SEQ ID NO: 21814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccagggagtaaatggtattggtttctgc

SEQ ID NO: 21815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccagggtcttttgctcccgccctattgt

SEQ ID NO: 21816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccaggtatgctccctaagagtaagcgat

SEQ ID NO: 21817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccagtggctgtggaacgtgatttgttct

SEQ ID NO: 21818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccatgtttgcgtcaacttccccgggggt

SEQ ID NO: 21819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacccaagaatgactgcacccacgcgcacc

SEQ ID NO: 21820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacccacacacactgctttttcgtcttgct

SEQ ID NO: 21821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacccagccctcgagacatccacgccgttt

SEQ ID NO: 21822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccccatcagtgtacagtcagcctacgcc

SEQ ID NO: 21823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccccgcacagcgacagcacaacctatgt

SEQ ID NO: 21824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacccgactgatgaacgtgcactgtcacta

SEQ ID NO: 21825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccctgagattaactgaccttttaacctt

SEQ ID NO: 21826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgacgtcatgcttacatcagcgttcgt

SEQ ID NO: 21827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgattattactgaatcgatgccagatg

SEQ ID NO: 21828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgcacggaggcgcaccccggtccttct

SEQ ID NO: 21829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgcggccacgcctccagctatgtggta

SEQ ID NO: 21830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgcgttgcactatacggcgcgatgacg

SEQ ID NO: 21831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccggcgattgtgtccagccgtagctctt

SEQ ID NO: 21832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccggcggatgaacagaaagctcgagatc

SEQ ID NO: 21833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccggtcgcacccgcggcacatccgggtg

SEQ ID NO: 21834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgtaacagggatctcgcggctgtgatg

SEQ ID NO: 21835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgtatcttcgtaggggtgttacttcgc

SEQ ID NO: 21836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgtctactactatccggagatgcccgt

SEQ ID NO: 21837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccgtgggcatggtaaaggccaatatgca

SEQ ID NO: 21838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctagctcgagaggtactgctcaggggc

SEQ ID NO: 21839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctaggaagaggcaatacggaacccagc

SEQ ID NO: 21840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctatatacgttcacctcttgctcggtt

SEQ ID NO: 21841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctatgtcccaccagccacacgccctac

SEQ ID NO: 21842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctctcagtttcccaagctactaggcat

SEQ ID NO: 21843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctgagggaggtggaccaaccctttatc

SEQ ID NO: 21844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctggcatccagcgcttaccagacatca

SEQ ID NO: 21845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctgtgtattccctcaatccggggctaa

SEQ ID NO: 21846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaccttacaggggctgacctcggttgctta

SEQ ID NO: 21847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacctttccatcactaacatttaagcggta

SEQ ID NO: 21848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgacaggctggcgatgggttacttggtt

SEQ ID NO: 21849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgacgacgtatggtgggacgctcgattg

SEQ ID NO: 21850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgacggggcaggcacagaagagttcttg

SEQ ID NO: 21851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgacgtgtgtggtgcgagtggttgccta

SEQ ID NO: 21852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgagtgcgcataccagagcggtcccgtg

SEQ ID NO: 21853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcaaccacatagtccgtgtgcttttgt

SEQ ID NO: 21854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcacatggccgcttccgtgtgtgcaac

SEQ ID NO: 21855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgccaggttcgcgatacatcggtggtta

SEQ ID NO: 21856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcgcggaagctgcgacggtcacttgcc

SEQ ID NO: 21857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcgctacatggcggcaatctgctgccg

SEQ ID NO: 21858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcgtacgcgacgcaggtgtcctgggcc

SEQ ID NO: 21859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgctgtgctactaatgtgtggtatggcg

SEQ ID NO: 21860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgcttaattaaagttcatcacgtttctc

SEQ ID NO: 21861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggatatatatgttaaggggatggatgg

SEQ ID NO: 21862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggcgagaggctggtcttacctgacatc

SEQ ID NO: 21863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggcgatgtacggcggggagaaggaacg

SEQ ID NO: 21864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggcggactgtagctatgtgcacggtgg

SEQ ID NO: 21865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgggcgcaaactgaatgtttgaaggttg

SEQ ID NO: 21866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgggctttgaacgtgcgggtgagttgcc

SEQ ID NO: 21867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggtaccggacgtcctcgcggtctggtt

SEQ ID NO: 21868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggtgacgagcaggacggatggccgagc

SEQ ID NO: 21869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacggttttctggctctttcggggtgatcg

SEQ ID NO: 21870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtacgattagaattaagccctctgagt

SEQ ID NO: 21871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtagaaggaacgtctggtacgtacttt

SEQ ID NO: 21872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtaggtggcgaccaagcgagtgacacg

SEQ ID NO: 21873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtctgctaagtacattcgcggaacctt

SEQ ID NO: 21874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtctggattccacctggccgtagggga

SEQ ID NO: 21875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtgctcttagcccttgcgactacctcc

SEQ ID NO: 21876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtggctttgcgaacggctgcggtgcgc

SEQ ID NO: 21877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtggtctatgctgatcgtccgggtcta

SEQ ID NO: 21878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtgtctttgtaaactaggctgagtttg

SEQ ID NO: 21879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgttcatgactgacgagatgggcccttc

SEQ ID NO: 21880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgttctcatgaaagcgcgcgtggtgggg

SEQ ID NO: 21881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtttcgttggctaataatttgactaag

SEQ ID NO: 21882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacgtttgagcggcacccaaaccctacata

SEQ ID NO: 21883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactaatctggttaaactgtgttcgcactg

SEQ ID NO: 21884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactacgtttacgatttgcactggttcgtc

SEQ ID NO: 21885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactatcccatataggtcatttttttttgg

SEQ ID NO: 21886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactatgcaaacttcaggagggactaattt

SEQ ID NO: 21887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcaaattgttcgagggttacttagcgg

SEQ ID NO: 21888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactccaggtacgggaattatcgcgcaggt

SEQ ID NO: 21889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactccgattggggcgatgtcgtgcatgac

SEQ ID NO: 21890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcgcacgggtagcttaatcaacgcctt

SEQ ID NO: 21891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcgcatcagttatcgcaaattttagga

SEQ ID NO: 21892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcgcatttagatgcagtgatcctaggt

SEQ ID NO: 21893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcgcgaatgtgaccccttcgccctgaa

SEQ ID NO: 21894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcgctgcgcagctggactacgcgtgcc

SEQ ID NO: 21895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcggtgcatagcctgcatgccgccaat

SEQ ID NO: 21896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactctgctaggatgagattgtttttgttc

SEQ ID NO: 21897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcttcagcgggtgggtgacttccgtct

SEQ ID NO: 21898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactcttcagcgtgcatggagggcggatgg

SEQ ID NO: 21899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgaccacgtttaatgcacaccgacgtc

SEQ ID NO: 21900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgactgccagagatgttcttgcatctg

SEQ ID NO: 21901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgcggcagggtaatgtttacgcccaag

SEQ ID NO: 21902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgcttggcactcagcaggcaggcgata

SEQ ID NO: 21903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactggacagatcggttgtgtgatggccaa

SEQ ID NO: 21904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactggagcgagtgctctcacgttcgttgt

SEQ ID NO: 21905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactggaggtggggatagagcccggatagc

SEQ ID NO: 21906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactggttgttgtggcattctccgcgttga

SEQ ID NO: 21907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgtcacgttatgccgtcttctcgggcg

SEQ ID NO: 21908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactgtgtggggggtacaaccttctcgctt

SEQ ID NO: 21909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttaaacccaggatggactacctggatt

SEQ ID NO: 21910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttagcgaaagcccaagggtttttgcca

SEQ ID NO: 21911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttcagttgtggttaggcgcccagggtc

SEQ ID NO: 21912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttcccctctcattcgactccggaccca

SEQ ID NO: 21913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttcgacaattgtaactgctcgccgttg

SEQ ID NO: 21914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttgctgctccggggactctaagaaaga

SEQ ID NO: 21915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttgcttaggattagatgagtcccgtct

SEQ ID NO: 21916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgacttgggtctcacagttatacttaacagc

SEQ ID NO: 21917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactttatgaatcgttaaggtccaactgca

SEQ ID NO: 21918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactttggactgcgagtgggtggtctatgc

SEQ ID NO: 21919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactttgttgcgcaattgctgaggatcggg

SEQ ID NO: 21920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgactttgttgtgtatttaaggaatccggcg

SEQ ID NO: 21921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagacacaattggccaatcacgccgcgcga

SEQ ID NO: 21922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagacccctcgatgttgagctggctgagcc

SEQ ID NO: 21923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagaccgaacgattgggtggttgcacgtct

SEQ ID NO: 21924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagaccgttttcttgtggcttagtggtcta

SEQ ID NO: 21925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagacgagcagtctaggacttgctcctcgg

SEQ ID NO: 21926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagactaggcgatgttcctggtgaggtggg

SEQ ID NO: 21927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagactctccacatcggtgacatctccctg

SEQ ID NO: 21928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagacttgcgctgatgcgatttgattgtgt

SEQ ID NO: 21929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagagatgctattatcaggcttacatgaaa

SEQ ID NO: 21930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagagcaagtgcgcgttgcatgggaatgtc

SEQ ID NO: 21931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagagcgatggttatcacttatcctgaccg

SEQ ID NO: 21932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagagctacgatattgcgactgctgtgtgt

SEQ ID NO: 21933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagaggtgtgtgggagatgtcgctcgccca

SEQ ID NO: 21934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagagtcgacgatcgaatggtaataggttg

SEQ ID NO: 21935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagataggcgttcgcttcactggacatcct

SEQ ID NO: 21936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagatcgacgcgaactttcgacgctgaatg

SEQ ID NO: 21937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagatgggattgggtgtgcaatactcaatt

SEQ ID NO: 21938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagatgtaaaggacgcgtccaacagcactg

SEQ ID NO: 21939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagattgggacggggtggtacgctggagcg

SEQ ID NO: 21940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagatttgacatgcgctcaactttcttatg

SEQ ID NO: 21941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcaacattacttcgcacgtaataccggg

SEQ ID NO: 21942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcaagagcatttccgggctatggccggg

SEQ ID NO: 21943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcaatgccagaatggtggcgtcgatgtg

SEQ ID NO: 21944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcacagccgctgtggtctgtttggcatg

SEQ ID NO: 21945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcacagttaatttgatcggttgggttgc

SEQ ID NO: 21946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcacatgcgcgattttgtagctgtgatt

SEQ ID NO: 21947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcacgcgagcatgtctaacctcgacacc

SEQ ID NO: 21948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcacggtaagactcgtcgcgtcgtggaa

SEQ ID NO: 21949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcagacaaggagaattggtaactggtct

SEQ ID NO: 21950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcagaggcgaacctgagcctgacggccg

SEQ ID NO: 21951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcagcgggatcatctggattgcggttat

SEQ ID NO: 21952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcagcttgcgttggatcatcaagggggt

SEQ ID NO: 21953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcaggacgagtcggttagagtggcggcg

SEQ ID NO: 21954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcagtttctggcatttatggggacttag

SEQ ID NO: 21955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcatcttccttccctaccggaattggtc

SEQ ID NO: 21956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcatgccattcgcaggggtcatagtccg

SEQ ID NO: 21957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcccacttatgcaaaggaaatgctggag

SEQ ID NO: 21958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagccgatggacgattacatcggagttagt

SEQ ID NO: 21959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagccgctgtgttttttctctacaggcact

SEQ ID NO: 21960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcctcttcgatgaagttatgagtcatct

SEQ ID NO: 21961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcctgcggtgtcgtgtggggcactggcg

SEQ ID NO: 21962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgaacgtgaggttcgatgcatgtgttt

SEQ ID NO: 21963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgagacggagggatggatacccgacgc

SEQ ID NO: 21964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgagcgaccgtcgcttcgatcagtctc

SEQ ID NO: 21965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgatcttgctcccctcgttctgggtgc

SEQ ID NO: 21966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgatgtatgtaccgttgagaggtggag

SEQ ID NO: 21967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgcatacatatataggattcgggatac

SEQ ID NO: 21968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgcatttggttggtggtggtcagtgtg

SEQ ID NO: 21969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcggcgattctatatatcattaaaccgg

SEQ ID NO: 21970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgggaccagtgggtgaccctgagtcgg

SEQ ID NO: 21971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcggtacttaggactggcgaagggagtg

SEQ ID NO: 21972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcgtcggttggtgctttgtctggtcttg

SEQ ID NO: 21973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagctaaaatctcctgctgccatcatgatt

SEQ ID NO: 21974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagctcagacccatagcatgcccatcgtcc

SEQ ID NO: 21975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagctgacggtccgtgtggtggtggatgtg

SEQ ID NO: 21976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagctgtaacggcaggatcgtatcatgtca

SEQ ID NO: 21977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagcttgtaggctagttccaaaaactcaga

SEQ ID NO: 21978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggaaagaagcatgcccggggtcggttgg

SEQ ID NO: 21979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggacatagatggaaacgctcaggctagg

SEQ ID NO: 21980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggacggcggtacgttctatgtagtaggt

SEQ ID NO: 21981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggactatggcgcaggggtgactgctcgc

SEQ ID NO: 21982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggagtccgactcgggatttacgcaaagt

SEQ ID NO: 21983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggagttggaggggcatctttttccctgg

SEQ ID NO: 21984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggataaggtttcaggtattcgtgccgtg

SEQ ID NO: 21985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggatggcggtctgagcgggtgttgcccc

SEQ ID NO: 21986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggattgtgtcagccctactaagtgtgtg

SEQ ID NO: 21987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcacagggcactttcgcgggcgaagcg

SEQ ID NO: 21988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcacgataactgaagtgggatgcggtt

SEQ ID NO: 21989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcatcgccaggttcgtccgaataggcg

SEQ ID NO: 21990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcatttatggaacgtaaggaactgggt

SEQ ID NO: 21991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcgcatctatgttatagctgatgtcgg

SEQ ID NO: 21992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcgtcgatacgttagcctgaaaaggag

SEQ ID NO: 21993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggctgaagagtttttgagtatcggatgt

SEQ ID NO: 21994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggctggtaagtagctgccgttcagacgg

SEQ ID NO: 21995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggctggtgcttggtatgaggtggatccg

SEQ ID NO: 21996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggcttgaactacagtattgcagggaaat

SEQ ID NO: 21997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggctttttgctgcttgtagtccggcttc

SEQ ID NO: 21998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggaattaacttcatcttctttccagac

SEQ ID NO: 21999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggagcgatactggggttgatttagtgt

SEQ ID NO: 22000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggatcacgtgtgctcgtcaacgccgac

SEQ ID NO: 22001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggatcggagtcgtgtccgagtggcgac

SEQ ID NO: 22002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggcaacaatggctcttgttcaggaagc

SEQ ID NO: 22003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggcaacccgtacggcaagtgaatttgg

SEQ ID NO: 22004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggcgagaagagtattcgatggtaccta

SEQ ID NO: 22005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggggcagcatggagaggagagcggttgg

SEQ ID NO: 22006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggggcgagcgctttcttttgttctccct

SEQ ID NO: 22007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggggggaaattcaagcgcaaacggttta

SEQ ID NO: 22008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggggggggccctacagccaagttgcca

SEQ ID NO: 22009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggggtttcgactaggctgtccgacgtat

SEQ ID NO: 22010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagggttgcgacgagagggatcctcagctt

SEQ ID NO: 22011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggtagggggccgcttctttcactaatat

SEQ ID NO: 22012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggtccgactgacacagcttggttacacc

SEQ ID NO: 22013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggttaaccggtactggagcacttctgct

SEQ ID NO: 22014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggttcgatggcaggggcggagacttggg

SEQ ID NO: 22015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgaggttgtttgattacggggacccgagtca

SEQ ID NO: 22016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtacgaagagatcttcatgttattcagc

SEQ ID NO: 22017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtacgacaccagcaaacaccggtgggag

SEQ ID NO: 22018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtagcttgcggtccgcgctcggtttatc

SEQ ID NO: 22019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtataccttccgtgcctcctcggacatc

SEQ ID NO: 22020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtatcctacgggttagattctacgtttt

SEQ ID NO: 22021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtatggactgggcgggagacggactgcg

SEQ ID NO: 22022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtcagtagcattcgcaaaaagtggtgct

SEQ ID NO: 22023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtccgtcaacgatgaggatcacgtctgg

SEQ ID NO: 22024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtcctcgatccccccttcccgtagtccg

SEQ ID NO: 22025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtctgtgcgtgcgaaatcagtgctaacg

SEQ ID NO: 22026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgaagtagtggcctttttgtacgtagc

SEQ ID NO: 22027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgaggtggaggacgtgcaggtttaatt

SEQ ID NO: 22028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgcgctatgataagctaagtcatcatc

SEQ ID NO: 22029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgcgtaatgttattagaccaagtctcc

SEQ ID NO: 22030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtggaccacgttttcgtctactgcgtgt

SEQ ID NO: 22031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtggagtctgccctaacgtttccttgat

SEQ ID NO: 22032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtggcgcaggatcaggatcccgctggtc

SEQ ID NO: 22033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtggtcgagacattcaagaccgatgcaa

SEQ ID NO: 22034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgtcgctctagttgtttcccgttgccc

SEQ ID NO: 22035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgtcgggtggagaaggtcgcacagaca

SEQ ID NO: 22036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgtgcccaatgcacatgttcgttcacg

SEQ ID NO: 22037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgtgctagttcgtccgggtttggcaag

SEQ ID NO: 22038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgtgtcgcttgtaactgggttttcaac

SEQ ID NO: 22039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtgttaatgcgtttacgatgtcctttgg

SEQ ID NO: 22040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttaggctgagaatgctgggtgatctgg

SEQ ID NO: 22041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttagtggcgttttcgtgtcttctaggt

SEQ ID NO: 22042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttatgcacacctcttagggacaggctt

SEQ ID NO: 22043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttcacttctggtcattctgtgtccata

SEQ ID NO: 22044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttcatagcgacgtgttggtctgcttcg

SEQ ID NO: 22045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagttgcgcactagtatcgactataacaac

SEQ ID NO: 22046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgagtttcattggtgactgcgagcgacgggg

SEQ ID NO: 22047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataaagttaaaccagagggtacagtgtgg

SEQ ID NO: 22048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataaatgacagcgcggattgatggcctgc

SEQ ID NO: 22049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataataacgcctttactttgcgatcggag

SEQ ID NO: 22050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataatgacgccgtcgctctcacgatcaag

SEQ ID NO: 22051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataatggacgtggtaacacctgggtgctc

SEQ ID NO: 22052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataatgtcccgggaatactcggggtgtcc

SEQ ID NO: 22053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataatgtttattgagacatatattggtag

SEQ ID NO: 22054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataattgcacctctccttaaacgaccact

SEQ ID NO: 22055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatacagcatggaacttacgaacgcgcctg

SEQ ID NO: 22056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataccaaatgcaaaccaggtgcgtattcg

SEQ ID NO: 22057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataccgatggggtgccggtgatttcggct

SEQ ID NO: 22058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataccgttggaatactttcactctgaagt

SEQ ID NO: 22059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatacggattgttattcgagggctttgagc

SEQ ID NO: 22060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatactctcggagtcttgttaaaagtgtgg

SEQ ID NO: 22061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatactgcacccaagaacgctcacggtacc

SEQ ID NO: 22062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatagaggaggaacgaaccatcgttttgtg

SEQ ID NO: 22063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatagcgggtcagtccggatcaaaaagttc

SEQ ID NO: 22064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgataggtaagttcatacatgctgttcgagt

SEQ ID NO: 22065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatagtatcattgactgggcttggcatgct

SEQ ID NO: 22066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatagtcgatctcggtcaaccacttcggga

SEQ ID NO: 22067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatatatccatagactcggtgtcgttggcg

SEQ ID NO: 22068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatatcattacagtgaattcgtttagccca

SEQ ID NO: 22069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatattcctgtaaggaattgtctccgccct

SEQ ID NO: 22070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcactaaaaacgcatcccacttcgtttt

SEQ ID NO: 22071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcagaactcgccaagacttgatgtttgt

SEQ ID NO: 22072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcagcgtacccggggaccttttcagtgt

SEQ ID NO: 22073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcagcgtagtgcgtgtggatcctttgcc

SEQ ID NO: 22074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcagctccggactgggtttctagttcgt

SEQ ID NO: 22075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcagctgtaaagcaacccgaccctggag

SEQ ID NO: 22076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcatcccacggtaatgtcacggggagtg

SEQ ID NO: 22077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcatttacggctagaccacatgcttcga

SEQ ID NO: 22078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccaatatttctcggtcatgtttcccgg

SEQ ID NO: 22079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccacactcgggtttaccgggcttactc

SEQ ID NO: 22080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccagccgacgggtcgcggtttccgttc

SEQ ID NO: 22081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccagttgaatgtacttgctcctaagga

SEQ ID NO: 22082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccatcaacgttctcgagtgtcgtggcg

SEQ ID NO: 22083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccgagcgaactcgaactgccagacgct

SEQ ID NO: 22084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccggaacctgcaggtcctgcgacagcg

SEQ ID NO: 22085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatccggtcttcggagcagtttatgtaggc

SEQ ID NO: 22086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcctgaggcgcacatcaagccggtccta

SEQ ID NO: 22087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgaaccgctatgccccaggcaggtgtt

SEQ ID NO: 22088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgaatgtcattcgtcactcagccccac

SEQ ID NO: 22089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgagtaagtggacggtccccagcgtct

SEQ ID NO: 22090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgcaggttacgccggatttacccctgt

SEQ ID NO: 22091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgccttggtttgtactctacggttgct

SEQ ID NO: 22092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgcgcaacatcggtgcatcttccctgc

SEQ ID NO: 22093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgcgcgggaaactgtggtctccggtgg

SEQ ID NO: 22094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgcggtacggtaatcactgtgacctgt

SEQ ID NO: 22095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgcgtatacacatgacttgatatggtt

SEQ ID NO: 22096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgctatagtctgtaaatatgcacctag

SEQ ID NO: 22097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgctgtaggtcagcacccccttcccgt

SEQ ID NO: 22098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcggacgggcttatcacgtgcctccagt

SEQ ID NO: 22099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgggcgcacttggcggtgaactctcct

SEQ ID NO: 22100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcggggagtcggctaagcccgggcgagg

SEQ ID NO: 22101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgggggcgcgacgtggggtaatggtgg

SEQ ID NO: 22102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcgggtacatcgcttaatcacttcgcga

SEQ ID NO: 22103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatctaagcgtccgtgtttcttgctcgagg

SEQ ID NO: 22104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatctatcccgtctgcttgactctattgat

SEQ ID NO: 22105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatctcgattgtggtcctgccgggcacctc

SEQ ID NO: 22106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatctgtcgcgaggttagcagtcggctgcg

SEQ ID NO: 22107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatcttggaacgtaaggcgttcgtgtcacg

SEQ ID NO: 22108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaaagactcaggcgtgttcctactctg

SEQ ID NO: 22109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaacctagcgttcgcgggatatccatc

SEQ ID NO: 22110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaacgtatacagggacggctgcacaag

SEQ ID NO: 22111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaaggaagtcctacaagtcgctcgtcc

SEQ ID NO: 22112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgagcacgacagtcgaggccggtatacc

SEQ ID NO: 22113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaggctgcgagtaattccggtgtggcc

SEQ ID NO: 22114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgaggtccagtgtcgcaggcctcgggca

SEQ ID NO: 22115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgagtcagggtgaatggaacgttgtacg

SEQ ID NO: 22116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgatcctattgaaagatcttccgtcgca

SEQ ID NO: 22117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgatcgctgcatttcacctaagttccga

SEQ ID NO: 22118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgatgttgagacggagggttgagactgg

SEQ ID NO: 22119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgcagacgctaaacaccccacataatcg

SEQ ID NO: 22120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgcagccatttgattaaacctctacgtt

SEQ ID NO: 22121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgcaggcgtctgggttaggcgtggtcgt

SEQ ID NO: 22122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgcatagccgatggcactttacctttgg

SEQ ID NO: 22123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgccgtaccgaacccacagcccctcggt

SEQ ID NO: 22124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgccttaacggtgtgatcaatgtgtttc

SEQ ID NO: 22125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgctcagagccccaggcttggattttcg

SEQ ID NO: 22126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgctcgtcagagtctgaaatcaacagtc

SEQ ID NO: 22127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgctgacagactcttccatgacacgttc

SEQ ID NO: 22128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgctgttcatgggccttcggcctctagc

SEQ ID NO: 22129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgctttatcaatttgcgtaatacggtcc

SEQ ID NO: 22130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggaaggtgcttactagcagcgcttatt

SEQ ID NO: 22131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggatgggtgcggagatgtcgcgcgtgg

SEQ ID NO: 22132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggattcacacagcccgaattgcgctgc

SEQ ID NO: 22133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgggactggcgagtcatcacttattggg

SEQ ID NO: 22134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgggcgccggccgtggtccgtgttagga

SEQ ID NO: 22135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggggaaggtatggactaggtaacgcgt

SEQ ID NO: 22136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggggcgctacgaggtaaatgcatgaca

SEQ ID NO: 22137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggtacgcgcgtcttacgctttttgacg

SEQ ID NO: 22138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggtcgggcaggagttagtagtaccagg

SEQ ID NO: 22139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggtgaaccctcatgaagggtccgtcct

SEQ ID NO: 22140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatggtgcccaaacaaccaaatgccgaccg

SEQ ID NO: 22141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtaccaggaccagctgctcaaatgtca

SEQ ID NO: 22142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtactgcggtcgtgtcgacgactggct

SEQ ID NO: 22143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtagagggactgtggcttgtggcttat

SEQ ID NO: 22144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtagtgcgctgttgttagcctgtttct

SEQ ID NO: 22145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtagtgtcccattgttcttttaagagg

SEQ ID NO: 22146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtatggctgtctcgacataaaaacgag

SEQ ID NO: 22147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgttagatggtaggggctttggggacat

SEQ ID NO: 22148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgttcaattcttatcactcagcgtgggc

SEQ ID NO: 22149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatgtttaatacagatgtttcaccataaat

SEQ ID NO: 22150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattaccgggctgagcttgctaactcggct

SEQ ID NO: 22151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattacgaaaccgcggctcttcttacctct

SEQ ID NO: 22152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattagcttagacgggtgatattcgagggt

SEQ ID NO: 22153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattaggttacgagaggtgaagtggcacgc

SEQ ID NO: 22154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattagtccgtatcatgccatcttctcatc

SEQ ID NO: 22155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattataatatactgttattagtgtttccg

SEQ ID NO: 22156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattatggctggttcattttttggggtgcg

SEQ ID NO: 22157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattcacgtcattttagggtgcctgcttag

SEQ ID NO: 22158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattccaactagaaggctgccccaggtacg

SEQ ID NO: 22159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattcctaatcctcgttctgcatcctcggg

SEQ ID NO: 22160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattcctacgcgttctagctctagcccggg

SEQ ID NO: 22161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattcgcagtctatagatattggttgtctt

SEQ ID NO: 22162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattgatacctatttcatggattttggcta

SEQ ID NO: 22163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattggactggtggttgcaagcctatacgg

SEQ ID NO: 22164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattggagttttaggggcgattacttacca

SEQ ID NO: 22165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattgggacccgttctagtgacgggcggat

SEQ ID NO: 22166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattggggactgcgtccgctctgttaagcc

SEQ ID NO: 22167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgattgtggcgccctgttctgcgtaactgtt

SEQ ID NO: 22168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatttatctcgcagccttcggatccgatac

SEQ ID NO: 22169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatttcaccgcgtttgggacgtttttaggc

SEQ ID NO: 22170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatttcatttggtactcagcaatcgcatga

SEQ ID NO: 22171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatttggcacgggtgtgcgactacacagtg

SEQ ID NO: 22172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgatttgtttatatgctctcatgccgctggt

SEQ ID NO: 22173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaaagctattggcgcaagctcgttgggc

SEQ ID NO: 22174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaaccgttaatggtttcatgagtccata

SEQ ID NO: 22175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaacgcatcggacagacagtacgtcagg

SEQ ID NO: 22176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaacgtaaggtggggttgttagacggat

SEQ ID NO: 22177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaatccgcagacaatccgtaccttctgg

SEQ ID NO: 22178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaatgacggctttggggaaccgtgcgcg

SEQ ID NO: 22179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaatgtctatcaattccaggttcgctgg

SEQ ID NO: 22180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaacacgtaaacgcagcctccatgggtag

SEQ ID NO: 22181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaacagtgtgactggaaatagcgcccaca

SEQ ID NO: 22182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaccaccgtgtggcacttcggatgcccg

SEQ ID NO: 22183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaaccccgcgggacttgtacgtctaccta

SEQ ID NO: 22184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaacgacgctctgtaaccgccacggaaga

SEQ ID NO: 22185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaacggcagtctccgcgtcccgcctcgct

SEQ ID NO: 22186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaacgggacggggacagcttcgttccgca

SEQ ID NO: 22187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagaaccgaggcatcgtacggatctttg

SEQ ID NO: 22188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagaccggtttagatccgcaacccagct

SEQ ID NO: 22189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagagcgcgcagttggtaatccgagtgg

SEQ ID NO: 22190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagtaaagttcctttgtgtttaacagcg

SEQ ID NO: 22191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagtacatatgttttatcgcaaagctct

SEQ ID NO: 22192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaagtcctacgcgtacggtcttcgattgc

SEQ ID NO: 22193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatcataagccccctcagaatgtcggga

SEQ ID NO: 22194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatccaacgttggcggctcgagaggtgt

SEQ ID NO: 22195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatcgtgccaatgttctaatgcaggcgc

SEQ ID NO: 22196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatctggtttgttaaaaattggtagtgt

SEQ ID NO: 22197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatctgttagtcaaagcctttcagttac

SEQ ID NO: 22198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatgccataagtgacgatagtgtgagga

SEQ ID NO: 22199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatggactgcataggggcccgcatccat

SEQ ID NO: 22200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatgttgttgggaacttgcccagtttcg

SEQ ID NO: 22201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaatgtttgtccattagtctggtctcact

SEQ ID NO: 22202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacaaagtagtcaattctcgctcgggccg

SEQ ID NO: 22203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacaaatgggggtgatagcacgctggggt

SEQ ID NO: 22204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacaatactcatgggctttctgaggcggg

SEQ ID NO: 22205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacacaggcactacggctgcccttcggtc

SEQ ID NO: 22206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacacgcagatccccaagcgcataccagc

SEQ ID NO: 22207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacacgtagaaaggtaataattgtacctt

SEQ ID NO: 22208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacagacaacactgatcaccaagtatcgc

SEQ ID NO: 22209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacagacgtggttacctcacgagacgggt

SEQ ID NO: 22210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacagcgtgactttgaacgaccgattgtg

SEQ ID NO: 22211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacaggagcccaacgtatgattataagtg

SEQ ID NO: 22212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacatcacagagctgtcggtgaggcgtgc

SEQ ID NO: 22213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacatcacggttgtaaaatgtatctaaat

SEQ ID NO: 22214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacattcttggcgtcggtctcgagacagt

SEQ ID NO: 22215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacattgaagacgacgcttctgcttacgt

SEQ ID NO: 22216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacattggatcccaaacatggcgctagcg

SEQ ID NO: 22217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccaaagaagtggcgtgctagatgactg

SEQ ID NO: 22218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccaacgattttaaaacccgtgtcgtgc

SEQ ID NO: 22219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccaatcacacaaccggaagcttagccg

SEQ ID NO: 22220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccacgccgcgagtgtagccgcccttgg

SEQ ID NO: 22221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacccaaccattttcgcaatactcacctt

SEQ ID NO: 22222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccgcagctagttgtcacccggcgacca

SEQ ID NO: 22223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccggactcattgcaacctttccacctc

SEQ ID NO: 22224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccgggcctgctatccgcggggaagctt

SEQ ID NO: 22225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacctaggaagtgtgccggcttatgtcgg

SEQ ID NO: 22226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaccttaataagacgacgccgctcggggg

SEQ ID NO: 22227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgaatgagtcgaccgtcgggcagtaca

SEQ ID NO: 22228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgaccacccacacagtcccctctggtg

SEQ ID NO: 22229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgagagcagacggtatcccactgtcgc

SEQ ID NO: 22230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgagtcggttatcaacgagtgaaatat

SEQ ID NO: 22231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgagtctggatttgccaccgggaaagc

SEQ ID NO: 22232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgatagcgggctgtcgtgaagcgggtc

SEQ ID NO: 22233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgcatacgttttggtccttgtccgccc

SEQ ID NO: 22234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgccgccactcatatcccaatctgtgc

SEQ ID NO: 22235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgcgctaaggggtaggtgttgctccga

SEQ ID NO: 22236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacggctaacgctatagcttaatggcccg

SEQ ID NO: 22237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgggatggtgaatgcctaaggcccgtg

SEQ ID NO: 22238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgggtgcatacgccaaggtcccgctaa

SEQ ID NO: 22239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgtaccgcgacacgttagggcagtgga

SEQ ID NO: 22240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgtcgtcttgaattgttaagccagatg

SEQ ID NO: 22241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgtctgagggatacataatcggcgagc

SEQ ID NO: 22242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcacgtggggcccattagtaaaaggtgagc

SEQ ID NO: 22243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactacattcatgttttcagctcggcaag

SEQ ID NO: 22244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactactttggcctccgttgcagagtaga

SEQ ID NO: 22245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactagaacatttccgaccccatgtgctc

SEQ ID NO: 22246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactataattaattcggacgcgtggcgga

SEQ ID NO: 22247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactatcacccgccatgctccacgcgatc

SEQ ID NO: 22248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactcaccctaaccattgctgagcgtcga

SEQ ID NO: 22249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactcccagtggtgaccctgcattcggcc

SEQ ID NO: 22250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactcgtgcagaacagggtctgtgccctg

SEQ ID NO: 22251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactgtatttccaactggcagcagctgcc

SEQ ID NO: 22252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcactttgaaaatggtttgcgtcagccgct

SEQ ID NO: 22253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagaaagcccgaacgcgtggagacagtgc

SEQ ID NO: 22254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagaaccaaatcgtgatcacggtgcttgg

SEQ ID NO: 22255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagaatcgaagctcgtgcaatttggttag

SEQ ID NO: 22256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagaccggttcgtgcgtataaccttaggt

SEQ ID NO: 22257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagactactgtgcgttcttcccgggggtt

SEQ ID NO: 22258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagacttaagactgtacgtacgcccggaa

SEQ ID NO: 22259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagagaaaaaaacttggcgcttcttgact

SEQ ID NO: 22260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagagcaccgctggctgttggaagggagc

SEQ ID NO: 22261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagatactttcgtgtcagtcgtataaaac

SEQ ID NO: 22262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagatctactttccaaactggccgcttgc

SEQ ID NO: 22263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagatgaacggtaggggacgtgcgcgggg

SEQ ID NO: 22264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagatgaccagtagtttatcataagtgcg

SEQ ID NO: 22265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagcaacagtgttattgcggtattcgtat

SEQ ID NO: 22266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagccaaccggtcagccttcgcctagcat

SEQ ID NO: 22267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagccatgctcccttgcaacaaagtctga

SEQ ID NO: 22268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagccggtccattttccctgtggggtgag

SEQ ID NO: 22269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagcctggtgaaacggtcccttgggattt

SEQ ID NO: 22270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagcgactggatccgctttgctcggtttg

SEQ ID NO: 22271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagcgatccgcacctgggaaacgagggtt

SEQ ID NO: 22272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagcgcacgaatcctgccctgactattcg

SEQ ID NO: 22273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagctaatgtcccagaccgctcagaagcc

SEQ ID NO: 22274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagctccagtacactgctaactcggtcgt

SEQ ID NO: 22275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagctcgagtgagggattccatgggctcg

SEQ ID NO: 22276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagctctaaagattccgtctgtcgcgtcg

SEQ ID NO: 22277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagctgccggaccgattataactcgtgca

SEQ ID NO: 22278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggacattcaaggtacacattcgtacgg

SEQ ID NO: 22279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggacccgaggtacactgtacccagcac

SEQ ID NO: 22280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggagcgaaatatggaacggaggcaaca

SEQ ID NO: 22281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggagcgatagccgttcgggggaaatcg

SEQ ID NO: 22282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggatctgcaggagcggaattttcgctc

SEQ ID NO: 22283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggatggctactccgctcattcgacgat

SEQ ID NO: 22284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggatgggtggtgaagtggaatccatct

SEQ ID NO: 22285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggcaaaccgaaactcgtcgatcatgag

SEQ ID NO: 22286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggcacgtgaggctatggctgtactgcg

SEQ ID NO: 22287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggcgtcgcatgatagcaggtagcggct

SEQ ID NO: 22288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggggtcaatacatcttcgaagcttccc

SEQ ID NO: 22289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagggtcgctgtcgcatgagcggactcgg

SEQ ID NO: 22290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggtccggtcgtgcacggttctgtcttt

SEQ ID NO: 22291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggtccgtcggctcgccgtggggttgtg

SEQ ID NO: 22292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcaggtgttccttttcataccaccgcagga

SEQ ID NO: 22293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtaacaacaatacatcttcgccacgcc

SEQ ID NO: 22294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtcccgtcatgattcgttggtggtggg

SEQ ID NO: 22295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtctgaatgcagactagaggctgggtt

SEQ ID NO: 22296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtgcagggtcgaaaaggacgatacggg

SEQ ID NO: 22297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtgcgtagcagacgagttgtcgcgagg

SEQ ID NO: 22298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcagtgctcagcgcgaggagtccattgtgc

SEQ ID NO: 22299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcataaaagcgcgattaatttagtctctgc

SEQ ID NO: 22300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcataacggtgccgctcatcgctaacagcc

SEQ ID NO: 22301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcataactcggttcggggactgagatcctc

SEQ ID NO: 22302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcataactgttccctgagtctatgatccac

SEQ ID NO: 22303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatacatcgtctagggccgggttacgtca

SEQ ID NO: 22304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcataccgatggatgggcacaaccgaactc

SEQ ID NO: 22305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatagactggacattgggagggctaacgt

SEQ ID NO: 22306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatagagactagatgaaactcaatttccc

SEQ ID NO: 22307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatcaagggtcagcgcgcacgattcaagg

SEQ ID NO: 22308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatcacgactgctaccaagtttcaccatc

SEQ ID NO: 22309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatccacccatggccttggtttcgcacta

SEQ ID NO: 22310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatccactcgacgcttcggctttcgcccg

SEQ ID NO: 22311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatccatccctaagtcctgtgcccgtcgc

SEQ ID NO: 22312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatccctcctcgggacaacctgtagcagt

SEQ ID NO: 22313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatccgtaattaaataacccgaatgaccc

SEQ ID NO: 22314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatcgagtacccccatgtacccacacgag

SEQ ID NO: 22315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatcgggagtcaatgaaccggcccacgtg

SEQ ID NO: 22316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatctagcaacccagatgctcgtaacgaa

SEQ ID NO: 22317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatctgctcgtaccgaattgcattcccgt

SEQ ID NO: 22318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgaattgctatcatgccgcgggatttt

SEQ ID NO: 22319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgactaaacgcgagtctccccggtgtg

SEQ ID NO: 22320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgcccggttacgggatctgggggtttt

SEQ ID NO: 22321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgcgaccaacggtcgaggggggctagc

SEQ ID NO: 22322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatggctcgaaccgtggtaagccggatgt

SEQ ID NO: 22323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgggtaacggggatccggtaagctact

SEQ ID NO: 22324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgtatacgagacaccttaagctaatca

SEQ ID NO: 22325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgtgatcccgatctgggacggtactaa

SEQ ID NO: 22326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgtggctatgtcgggtttttcgtcttg

SEQ ID NO: 22327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatgtggctctcattttaagctcactatg

SEQ ID NO: 22328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattagatgatctcctgtaagttgccttc

SEQ ID NO: 22329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattagcctatcttggtgtgcgggcgtga

SEQ ID NO: 22330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattcatgctgttgttttcgccccttcta

SEQ ID NO: 22331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattccgcctgctagtggtcgaacatcgg

SEQ ID NO: 22332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattcgttaatcacttgttattccgtact

SEQ ID NO: 22333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattgaccgtatctgtgggtaaacgtctg

SEQ ID NO: 22334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattgcgttagtcttcgtcaggttgatat

SEQ ID NO: 22335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcattgctgtattcgttttagtaacacccg

SEQ ID NO: 22336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatttacacgaatcttagtaatcgcggtg

SEQ ID NO: 22337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatttgcaatacgacgacttatggtggtt

SEQ ID NO: 22338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcatttttttggcctcgcgccactttgttc

SEQ ID NO: 22339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaacaaaacgagccaattactctctttt

SEQ ID NO: 22340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaacgagtctgctgaatctacctagcga

SEQ ID NO: 22341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaacgcgatctcacttacaatatttgta

SEQ ID NO: 22342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaactaagttgtgcagcttcaagacaac

SEQ ID NO: 22343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaagagcgagtggaccttgtggtattcc

SEQ ID NO: 22344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaagatgcgcaacatcataggatatggc

SEQ ID NO: 22345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaatgaggagcgcttgagtttttcgggt

SEQ ID NO: 22346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccacagtgcgtgatccatatctccgcgcc

SEQ ID NO: 22347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaccccaacaggatactaagctggcgtt

SEQ ID NO: 22348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccaccttatgtatcactaaaccccgtatt

SEQ ID NO: 22349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccacgacacaattgctcatcggcgtatcg

SEQ ID NO: 22350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccacgatgacattcgtccaatgaaggtgt

SEQ ID NO: 22351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccacgccatgctattgctgcttcgatgat

SEQ ID NO: 22352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccacggacacagaagcagaagcttgacac

SEQ ID NO: 22353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccactacgatcggcactaaagctttaagt

SEQ ID NO: 22354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccactgaacgcaagcagcgctgactgttg

SEQ ID NO: 22355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccactgcataggtaaaatgcggtttagcg

SEQ ID NO: 22356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccactggaaaccgttacctgtcgaacgcg

SEQ ID NO: 22357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccactgtttaacttggattgcgcttcctg

SEQ ID NO: 22358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagatcgtgttctctttccagctcattc

SEQ ID NO: 22359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagattcgggaataccgagatgggcgta

SEQ ID NO: 22360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagatttaatttattgaggcatcagggc

SEQ ID NO: 22361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagcataactgactagtgctgtcttttt

SEQ ID NO: 22362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagcgaatgctgcgcgagagttaatgct

SEQ ID NO: 22363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagcgttcgcctacctttgagggcgctt

SEQ ID NO: 22364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagctcatctaggccgtttttgcgtgca

SEQ ID NO: 22365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagctgtttagtatcttgcagtgcttgt

SEQ ID NO: 22366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagggaaatgttgtaagcgcttcgtgtt

SEQ ID NO: 22367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagtccgaaccatccggcaacgggcgtt

SEQ ID NO: 22368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagtgtagctcgttgggctagggccggt

SEQ ID NO: 22369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagtgtgcagtctagttgggtgatgttg

SEQ ID NO: 22370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccagttatttgcgttccagtgggcatgtg

SEQ ID NO: 22371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatacgagggggggaattacgcccggtt

SEQ ID NO: 22372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatatgagtactgtacgaagcgaaacgt

SEQ ID NO: 22373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatgaagttaaggcgaacgatcgtcgac

SEQ ID NO: 22374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatgagaacgagtcctgccaaccttgtc

SEQ ID NO: 22375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatgaggggtgaactaggatagtcccta

SEQ ID NO: 22376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccattacccgagagactctgcaacaacgc

SEQ ID NO: 22377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccattgcccgcgtacgaatgcctcaaaca

SEQ ID NO: 22378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccatttcgcacagtattgggtggggcgtg

SEQ ID NO: 22379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccaaacacagagcgcgcacggttaccgg

SEQ ID NO: 22380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccaacgggtcgaggacattacagccgtc

SEQ ID NO: 22381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccacacccccagagcgctgtacggtcgc

SEQ ID NO: 22382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccactagtcagcaattaccgcaccgtgc

SEQ ID NO: 22383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccagaacaggacaccgggtgtttgtaga

SEQ ID NO: 22384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccagtatgacaagctcagttgcccgagg

SEQ ID NO: 22385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccataaccgagcccacgcgggtattgga

SEQ ID NO: 22386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccatgttcagttgttgttaccccgctcg

SEQ ID NO: 22387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccccaagctgtgccacattgcgagcgttg

SEQ ID NO: 22388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccccacatttcggctcgcttagtgcggag

SEQ ID NO: 22389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccccatggaacgttacccgtttagctcgc

SEQ ID NO: 22390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccccagcacatgtcaaccacctgcctgc

SEQ ID NO: 22391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccctcgatcgaaagagtttgttcggctc

SEQ ID NO: 22392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccccttgttgatttttacaatgtttttaa

SEQ ID NO: 22393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgaatgcgattaactccgttcgaagta

SEQ ID NO: 22394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgagtgacaatcgaaagacgctgacgt

SEQ ID NO: 22395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgcgcagattgaaccgcggctacttgg

SEQ ID NO: 22396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccggaccgaacttctatgcttcaggaga

SEQ ID NO: 22397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccggctaatgcgcacctttgtatcggtc

SEQ ID NO: 22398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgggattcagggtcatcgacaagccat

SEQ ID NO: 22399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgggcatgagggactcggccgtctttc

SEQ ID NO: 22400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccggggaggtatgcagtgccgtgccgat

SEQ ID NO: 22401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccggtcttgttcgtcctacttctcgtca

SEQ ID NO: 22402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgtacccaaatctttcatcgttcggcg

SEQ ID NO: 22403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgttacgtagggcagtacacatcggct

SEQ ID NO: 22404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgttcgatgtgcccagataacacgcct

SEQ ID NO: 22405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccgtttcgatctcgttgaggcttccgtg

SEQ ID NO: 22406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccctacgagccccccaaacacggtacggg

SEQ ID NO: 22407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccctaggggtagatacacccttattcagt

SEQ ID NO: 22408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccctatgtgttcacctttgcgcttgctgt

SEQ ID NO: 22409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccctccgcagcttacacatatgcccgttc

SEQ ID NO: 22410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccctcgctgtggcactgaatagtgtagcc

SEQ ID NO: 22411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccttacaggttgacagtatttagcaagt

SEQ ID NO: 22412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccttgggaccgattggcacatactgtgc

SEQ ID NO: 22413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcccttgtgccaatccaaatacgcttcatc

SEQ ID NO: 22414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgaaagacatcgactcagagcccaggct

SEQ ID NO: 22415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgaatggtagtaggcacgccccgagttc

SEQ ID NO: 22416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgacaaaacgatggaggccagtggtttc

SEQ ID NO: 22417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgacatcaggcgcgttggagggcagggc

SEQ ID NO: 22418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgaccgcagcagcaacctcaacacgcgc

SEQ ID NO: 22419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgacttgcgacaagggctatgcgggtta

SEQ ID NO: 22420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgagagcagcgcacatcgcacacacatg

SEQ ID NO: 22421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgagcgatgctcccgagagagatgtcac

SEQ ID NO: 22422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgagcgcgttctcgctgttcgaatggaa

SEQ ID NO: 22423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcacgggacaactgtacgccataggtt

SEQ ID NO: 22424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcacgtatccttctttctgtttagggc

SEQ ID NO: 22425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcatcgtaggacgtctgacaacccatg

SEQ ID NO: 22426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgccaaggatccattcgattgcacgttc

SEQ ID NO: 22427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgccacgggcatacgctcgggcttcgga

SEQ ID NO: 22428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgccagctggaggtctcgatttgtcagt

SEQ ID NO: 22429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcccagtttcacatacgttctcagtat

SEQ ID NO: 22430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgccgaggtttgacttcgtgctgtatgt

SEQ ID NO: 22431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcgaggtaatttgctggtgctgactag

SEQ ID NO: 22432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcgataatcccctgtacgctgagcaga

SEQ ID NO: 22433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcgcatctgtcctctctgtgttggtct

SEQ ID NO: 22434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgcgtgaatgctgtatggtgttgtttag

SEQ ID NO: 22435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctaattcgtcgtactccacccacggg

SEQ ID NO: 22436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctagataggagggagcgtactgatcg

SEQ ID NO: 22437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctcctaaattgatgcaattagggtgg

SEQ ID NO: 22438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctgctccatacccgttcgtagctagg

SEQ ID NO: 22439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctggctcattctgagcgacctacatg

SEQ ID NO: 22440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctgtgtgtgtggttagcttgcggtgg

SEQ ID NO: 22441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgctttgttgaatgacggatccgtgtgt

SEQ ID NO: 22442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggacacgtcaggtgagccctccctgtt

SEQ ID NO: 22443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggagccaacggtccagctattggatcg

SEQ ID NO: 22444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggatacatcgatgagtaagacgacatg

SEQ ID NO: 22445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggcactccgtgattgtttcgtgggtaa

SEQ ID NO: 22446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgggacgaagtacgtttgccctggtgac

SEQ ID NO: 22447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgggttacatcctgtgcattgcgttctg

SEQ ID NO: 22448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgggtttagttatcggctgtcgttggaa

SEQ ID NO: 22449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggtgcagccccgtagtctgctcgttac

SEQ ID NO: 22450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggtgttcagcacgcgattatgatacgc

SEQ ID NO: 22451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccggtttaccgctaagatgtacggagcgc

SEQ ID NO: 22452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtaatgccggcccacgcggtgtgattg

SEQ ID NO: 22453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtacttcgtgtcccgttcactgattac

SEQ ID NO: 22454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtagacgactccgcgcggtttagtccg

SEQ ID NO: 22455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtattggttgctgtcacccgccagtct

SEQ ID NO: 22456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtcgagcgtagttcgggcggtttggag

SEQ ID NO: 22457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtctgtttcgtactagatgctgtcttt

SEQ ID NO: 22458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtgcagggatggctccttcagctcgta

SEQ ID NO: 22459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgttcacagttgtcgacacgacccaggt

SEQ ID NO: 22460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgttctcgcagaagcctacatacttggt

SEQ ID NO: 22461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccgtttttgccccaagtaacgacaggatc

SEQ ID NO: 22462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaaatggtgattccggaagctgacgcg

SEQ ID NO: 22463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaagactagcgggataatgaaagcggc

SEQ ID NO: 22464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaagcgttaggtgtgtacagccctgtc

SEQ ID NO: 22465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaataaacccccacttgcgtcgttcgg

SEQ ID NO: 22466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaatgcccgcgaattcggcgttgtgag

SEQ ID NO: 22467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctacagtttcggacctctacgtgttgcc

SEQ ID NO: 22468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctacttgaagtttagccgcagttctggc

SEQ ID NO: 22469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctagcgcaaactgtctagttaccgcttc

SEQ ID NO: 22470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctaggacatctcaggcgggacagtcttg

SEQ ID NO: 22471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctagttcttgggggtgatcgtgcctaaa

SEQ ID NO: 22472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctagtttattaagggagtgggcggacac

SEQ ID NO: 22473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctataaggacatgtggagtgttaggtgg

SEQ ID NO: 22474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctattttctagtgcatttcatttctctc

SEQ ID NO: 22475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctcaccagtgcatcatccaacgtcggct

SEQ ID NO: 22476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctccaggtcgggacgttggagattcaca

SEQ ID NO: 22477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctccatcctggagtccattctcgttccg

SEQ ID NO: 22478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctccattaacgagtcacagttcgatctg

SEQ ID NO: 22479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctcgacatatacctaacggtctttactg

SEQ ID NO: 22480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctcggcaacgttcggactcccggctctc

SEQ ID NO: 22481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctcggtccctttgttctgccagtgcgtc

SEQ ID NO: 22482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctctgtaagacgttccccaatcttgcgc

SEQ ID NO: 22483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgacacgccttgaaattaatcgagtag

SEQ ID NO: 22484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgacgccgacgagttatgttgtccggg

SEQ ID NO: 22485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgactacttcctggtggcgtgatcggg

SEQ ID NO: 22486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgagctgaatgggccggttgcatgcca

SEQ ID NO: 22487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgatactgttgttgctatgcggcgtgc

SEQ ID NO: 22488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgcctacttgtcagaacacctgcgctg

SEQ ID NO: 22489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgcctcgtgataaacgcacggtatctg

SEQ ID NO: 22490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctggcgatgtcacaccttaggttggacg

SEQ ID NO: 22491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgggagatgttgccatcggatcggagg

SEQ ID NO: 22492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgggggagcaactgtcagggtattgac

SEQ ID NO: 22493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgtcaactatcttatttcacggggtta

SEQ ID NO: 22494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgtcctcacccctctaatacttgctgt

SEQ ID NO: 22495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgtgtcagtgttatcagcaggttgtct

SEQ ID NO: 22496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgtgtccctgaaggtggtggaatttcc

SEQ ID NO: 22497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgttagtatggtaaagccgcccttcgt

SEQ ID NO: 22498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgttgaccgctattgatattgcggggt

SEQ ID NO: 22499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctgttgtgcacgatagtttgtagagcgg

SEQ ID NO: 22500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttaacctgtgtacgtgaatgggagggc

SEQ ID NO: 22501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttaacttatagcacatgcagtcgtcgg

SEQ ID NO: 22502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttacgttttccgggttcgcgcggttcg

SEQ ID NO: 22503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttatagctgctcggtgttttggccagt

SEQ ID NO: 22504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttatgctcaggagttgcagtggtgcgt

SEQ ID NO: 22505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttcaaatggtcgattagggtccttcat

SEQ ID NO: 22506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttcatctctaatccttcttcgtggttt

SEQ ID NO: 22507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttcatgcagaggatccgttgacagctt

SEQ ID NO: 22508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttgcctacctcattcgggctgtagccg

SEQ ID NO: 22509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttgcggttacgataggggcgacttgtt

SEQ ID NO: 22510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttgggagatgtatggcatgctgaccgc

SEQ ID NO: 22511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttgtgcgatggaggtttctttctagtc

SEQ ID NO: 22512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctttagtccgtcggggttttcaatttgc

SEQ ID NO: 22513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcctttgccaccccttgttctctggttcgt

SEQ ID NO: 22514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgccttttattcgtgttgaccttcccaatgg

SEQ ID NO: 22515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaaaagctctccgtttgtgtgcccgtg

SEQ ID NO: 22516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaaagagttgttcccctagcttacgcg

SEQ ID NO: 22517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaactgtgattgggattagctcgccac

SEQ ID NO: 22518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaagccccgtgtgggagagccggtcga

SEQ ID NO: 22519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaccaggtgctcaactcgcgttgaccc

SEQ ID NO: 22520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaacgtcgacttatcctctgtaacacta

SEQ ID NO: 22521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaacgtcgggattcggtcagccttaagc

SEQ ID NO: 22522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaagagtccgggtgtacgctcgtgcgca

SEQ ID NO: 22523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaagctacagggttggctcaattgccca

SEQ ID NO: 22524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaaggtcggctctggcacgcgatgagac

SEQ ID NO: 22525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaagtcaggctggggtcggatgtttcgt

SEQ ID NO: 22526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaatgcgtatcatgtggtaaatcttctc

SEQ ID NO: 22527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaatgtgatggagtgccggttgctgctt

SEQ ID NO: 22528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacaccacatggtccctgcgtgcggtca

SEQ ID NO: 22529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacacggatctatatgcatcagacgatc

SEQ ID NO: 22530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaccgatgggtgatgtagctcaggaatg

SEQ ID NO: 22531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacgggttccaacggtaagttaatggtg

SEQ ID NO: 22532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacggtccgactggtgtggggtctgcga

SEQ ID NO: 22533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacgtctgcaatggatacaccgcgcctg

SEQ ID NO: 22534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgacgtgtccctttagactttttaacgtc

SEQ ID NO: 22535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgactcgcatgactttaaagggattgacg

SEQ ID NO: 22536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgactctctcgggtaatgttattatgcgg

SEQ ID NO: 22537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgactttgctgggggtgtaaacggtccgg

SEQ ID NO: 22538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagactggtataccacttgtgcacatgc

SEQ ID NO: 22539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagagagtcaactatactagcgtgtgag

SEQ ID NO: 22540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagattttgacctcatccacatcttttc

SEQ ID NO: 22541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagcacgattcgtattgatccgggatgc

SEQ ID NO: 22542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagcagggcaatgcggaataagacatcg

SEQ ID NO: 22543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagcatgcaaggggcgactcatgtgcgt

SEQ ID NO: 22544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagcattcacagctgaagaggcaaaggc

SEQ ID NO: 22545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaggggatattttgcatatgcgtgccct

SEQ ID NO: 22546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgaggtaggtctggtgccggggttcgccc

SEQ ID NO: 22547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagtggaagtgacatccggtgagtaccc

SEQ ID NO: 22548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgagttgcacaatagcatccaaccgtcga

SEQ ID NO: 22549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatacttgcctttattgtcccctgcaag

SEQ ID NO: 22550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatcatcagtagccggtcctgatccgcc

SEQ ID NO: 22551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatcccgactgacttgtgggttacgttg

SEQ ID NO: 22552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatcccggcgctgtgtgaccacccgatt

SEQ ID NO: 22553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatgccaggggtattctggcgtttggtc

SEQ ID NO: 22554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgatgtgacaaacgagcgcgggtcccttc

SEQ ID NO: 22555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgattatagggcttccgtaccaggcaatc

SEQ ID NO: 22556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgattcagcacgcaccatacttcttatcg

SEQ ID NO: 22557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgattgaccgcccctagacgttatctcgg

SEQ ID NO: 22558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgattgcttccttttgttctgattaccgc

SEQ ID NO: 22559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcaagaataatacttggctgcaggtcgg

SEQ ID NO: 22560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcacatcaccagaggcaggtgctggggt

SEQ ID NO: 22561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcacgagcctctgttctgccacgagcgt

SEQ ID NO: 22562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcacgtgtccaatttgtcctgagcctgg

SEQ ID NO: 22563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcacgttatgcgacattgttgctcaacg

SEQ ID NO: 22564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcagactcgccgaatctatcaacgacgg

SEQ ID NO: 22565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcagatccttattggtcgggctgcttct

SEQ ID NO: 22566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcagcgatgtcaaaggatgtttaagctg

SEQ ID NO: 22567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcagcgtagagctcggagtccacagtct

SEQ ID NO: 22568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcagtacgtccaaggccgcccgtgctgg

SEQ ID NO: 22569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatagccggttctgagggaacggtatc

SEQ ID NO: 22570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatcctgttctggctccactgtgttcg

SEQ ID NO: 22571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatgagtcttcgtctgtcgtgtaagct

SEQ ID NO: 22572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatgattcactccatcgtgaccgaaga

SEQ ID NO: 22573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatgtcccgtcgaggttgttgctggcc

SEQ ID NO: 22574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatgtgattgtcctcattgttctcgac

SEQ ID NO: 22575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcatttttcacgggattaccttcggacg

SEQ ID NO: 22576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcccgacgagatctcaatgcttcgccgt

SEQ ID NO: 22577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcccgagtcgcatggaatctcatgggca

SEQ ID NO: 22578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccctttacgcgaactttccttcggatg

SEQ ID NO: 22579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccgaaaagtagagcgctatctgtgtgt

SEQ ID NO: 22580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccgcctggtgcacacttgcagatggct

SEQ ID NO: 22581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccggaactctctggtcacaatgggggc

SEQ ID NO: 22582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccggcgcttgacttccatcaaccttta

SEQ ID NO: 22583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcctaaggaatttacgtagtgcgtgagg

SEQ ID NO: 22584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcctagaatcagctgaattgcatggggt

SEQ ID NO: 22585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcctagctcaatcggctcagtgtatgcg

SEQ ID NO: 22586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgccttacctatcgaatttatgttcctag

SEQ ID NO: 22587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcctttccccctggactaccaccttgcc

SEQ ID NO: 22588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgaacacctcaagctttacccactccg

SEQ ID NO: 22589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgagtgtgacttggcgaccatgggtca

SEQ ID NO: 22590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgataaggatagagttagtggatatcg

SEQ ID NO: 22591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgattaacagcattgctaacgacatcg

SEQ ID NO: 22592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgcaagcaaggtaatggtccatgtgct

SEQ ID NO: 22593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgcgaaagatggtcaaaggtactcatc

SEQ ID NO: 22594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtaaacacacctgcgccaccattcct

SEQ ID NO: 22595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtagctccggtgtcggtgttgatgct

SEQ ID NO: 22596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtaggggccgaggccacacctgcgtc

SEQ ID NO: 22597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtcctgacttgccgttcatccttggg

SEQ ID NO: 22598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtctaaggggggtccgggacgatggg

SEQ ID NO: 22599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtcttggcgtccctggtcgactggga

SEQ ID NO: 22600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcgtttaccctccgcgttattctactgc

SEQ ID NO: 22601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctagagatttaccggccggcgttactt

SEQ ID NO: 22602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctagttaaattctaattttaattgcac

SEQ ID NO: 22603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctatgaagtcctgccgcttacttctac

SEQ ID NO: 22604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctcacacttgctttcggttcagccagc

SEQ ID NO: 22605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctccgcacatgtttcggcttactgggc

SEQ ID NO: 22606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctctcatcctagtgctgtatattgcca

SEQ ID NO: 22607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctctgtcttatcacaagccctttggtg

SEQ ID NO: 22608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctgagacctgaaggcgtcaccttgctt

SEQ ID NO: 22609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctgatgagtcgaaggctttcaggttgc

SEQ ID NO: 22610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgctgcttcagtaccgaatcactatgagc

SEQ ID NO: 22611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcttgatttcctgacctttctcctccac

SEQ ID NO: 22612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgcttggttatattgctggtattgatagt

SEQ ID NO: 22613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaaaatccggacggtgtactattggac

SEQ ID NO: 22614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaacccacaactttgtttgactggtag

SEQ ID NO: 22615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaaccggggggcacaatgtaggagagt

SEQ ID NO: 22616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaagcgatcctatccttcatcggagtt

SEQ ID NO: 22617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaatatatcatggcatgaccggggtgt

SEQ ID NO: 22618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggacatgacggataaagctgtccgatcg

SEQ ID NO: 22619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggacccttcgtagaggctacaatggctc

SEQ ID NO: 22620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggacgtgggggcaggtacactcggtgct

SEQ ID NO: 22621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggactaggtgggaacgccccccacgaac

SEQ ID NO: 22622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggactgtctcgtgcgtcttgtccctcta

SEQ ID NO: 22623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggagcgtcaggtactccagacggtgcac

SEQ ID NO: 22624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggaggttggtggttgtttgatgggccgg

SEQ ID NO: 22625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggagtagtggcacgcaagggcatcacta

SEQ ID NO: 22626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggataaaggtgtcgtgtctggtcgttcg

SEQ ID NO: 22627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggatgtcgggacattttgtgcgcgggta

SEQ ID NO: 22628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggatttatcctgttcactacgaaaaggt

SEQ ID NO: 22629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcaaaagggtattgagccaactcccgg

SEQ ID NO: 22630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcatcaatccagcatggacccttcgct

SEQ ID NO: 22631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcgagttacttatggttctcgtgtttc

SEQ ID NO: 22632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcgccccgctcagacatgtggcacgtg

SEQ ID NO: 22633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcgccgttgcaactgcccctcacactg

SEQ ID NO: 22634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcggcaatgttacgtgttctagatgca

SEQ ID NO: 22635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcgtaccacttggcaagtcttgcttgg

SEQ ID NO: 22636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcgtgacgaggtggaccgaattcgggc

SEQ ID NO: 22637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggctgtaactcccggcaagcagttcgca

SEQ ID NO: 22638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggctgtccccctgatactgactaaaatg

SEQ ID NO: 22639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggctgtgtggcagttggcgtgtttactg

SEQ ID NO: 22640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggcttacacttttcacgcatgggtttcg

SEQ ID NO: 22641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggctttactgttctgcctgaacgcggtg

SEQ ID NO: 22642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggaaaggcccctatggcgcgaacgggg

SEQ ID NO: 22643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggacaactcctcgatgggacgtggcaa

SEQ ID NO: 22644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggacgtgcgtgcatgtaagtgttcagg

SEQ ID NO: 22645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggagcgattggtggtgattgggcgcct

SEQ ID NO: 22646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggagtgctcgatgggtcaacggtttct

SEQ ID NO: 22647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggcccaagctgtctctgcgatatagtt

SEQ ID NO: 22648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggcccactcaccataaccggaaagctt

SEQ ID NO: 22649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggccgtggtgccccaggagttacggcc

SEQ ID NO: 22650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggctgactgcgcacttttaacgagcac

SEQ ID NO: 22651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggacagccattgcaatgcgataacgt

SEQ ID NO: 22652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggcaccactctttgcctgcgaagtgt

SEQ ID NO: 22653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggggccacagttcacggtacttggttg

SEQ ID NO: 22654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggtatgggcggttctcgagagtgtcc

SEQ ID NO: 22655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggtcaggcacgcgatagtgcctctgc

SEQ ID NO: 22656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggtcgggtggttgttctcggtcgtcg

SEQ ID NO: 22657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggtggatagtccgtaaccgccaccat

SEQ ID NO: 22658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggggtgtactaaattaagcggattgcgc

SEQ ID NO: 22659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgggtatacgggcttttattatcgtgttc

SEQ ID NO: 22660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtaaacgtccagacaggggacacgtgc

SEQ ID NO: 22661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtaacaccgtattgtgatccgttaccg

SEQ ID NO: 22662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtagccgaagaaccccccgtgacatta

SEQ ID NO: 22663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtcagatgtctcgtgtcccacggtttg

SEQ ID NO: 22664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtcattttatcactgcattcacgagtt

SEQ ID NO: 22665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggtctttatcacggtctaacgatgggcc

SEQ ID NO: 22666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggttcaggtctgtgattgatatgggttc

SEQ ID NO: 22667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggttctcagcttttgcccactggcgatc

SEQ ID NO: 22668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcggttggtggacgttatgctggcggggtt

SEQ ID NO: 22669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtaacgggcgtctgtgtacttttcggct

SEQ ID NO: 22670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtaagcctcattgctagcaagccggtgc

SEQ ID NO: 22671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtaatgccagcgaggggagagatccgtg

SEQ ID NO: 22672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtacactaagaccttgacccatgagggg

SEQ ID NO: 22673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtaccatcgtgactggttcatctgcgca

SEQ ID NO: 22674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtacgaagtatttgtgtccgacctcctg

SEQ ID NO: 22675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtagccgtacttcgggtttatcacggtt

SEQ ID NO: 22676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtagctcacttccatcaacgtacatagt

SEQ ID NO: 22677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtatgtaatcctttgggtttttcaggag

SEQ ID NO: 22678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtattgttgcgcccacttaactctgccg

SEQ ID NO: 22679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcacgctatcgaattcgttacgggtat

SEQ ID NO: 22680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcaggcgaggtgtctttaccgtccagc

SEQ ID NO: 22681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcatatcattcgggggccttgcgcatg

SEQ ID NO: 22682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcatcacgattcaatagtctgcgagtg

SEQ ID NO: 22683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcccgacctttagtgtgcgtctgagcc

SEQ ID NO: 22684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcctgtcgtcgtccatgttaacgggcc

SEQ ID NO: 22685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcgtatgtgaccttgtactgctttcca

SEQ ID NO: 22686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtctaagcaacgatctgtttagcggcga

SEQ ID NO: 22687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtctaattggaaatcatcggtgcgtaag

SEQ ID NO: 22688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtctgtccttgtgctgtgaccattctac

SEQ ID NO: 22689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcttcacgagtccccggtgccaaagcc

SEQ ID NO: 22690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtcttgacagcacgttacttgcggaaaa

SEQ ID NO: 22691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtctttgcgaaagacggctcatgcacgg

SEQ ID NO: 22692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgagctgaaacgtcgccccgcattctg

SEQ ID NO: 22693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgagttgtgagtccaccccaatgggcc

SEQ ID NO: 22694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgcaaaatacggtatccgtatttgtca

SEQ ID NO: 22695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgcagagcaatcgcgcgctcgggggaa

SEQ ID NO: 22696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgcagttggcagacgtactgtgatagt

SEQ ID NO: 22697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgccagggatgggtctgcgggatgttc

SEQ ID NO: 22698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgccatgctttgcttcccccatctcgg

SEQ ID NO: 22699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgccatggaaccgtccaagcctctccc

SEQ ID NO: 22700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgctcactatactatcgggcttcatac

SEQ ID NO: 22701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgcttctgggaaggtatcagagttcga

SEQ ID NO: 22702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtggtagctcacgtgactgctttctcgt

SEQ ID NO: 22703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgtggagggcggctccaggctggcgtt

SEQ ID NO: 22704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgttgattgcccctaagtgttgcgcga

SEQ ID NO: 22705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtgttgtatagtctgggccattaggagt

SEQ ID NO: 22706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttagacgttttcgcgttggccccgaca

SEQ ID NO: 22707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttagtgtcttccccgtcagaacccagg

SEQ ID NO: 22708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttatgcaattctaagttaggtcgctag

SEQ ID NO: 22709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttcactgagttgcaccatagtcgcctc

SEQ ID NO: 22710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttggtccttcgtcataagctaagcgcc

SEQ ID NO: 22711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtttggtcccccattgctccacagctac

SEQ ID NO: 22712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgtttgttgtatcctttcatgggctgtcc

SEQ ID NO: 22713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcgttttggtagcacacatccagggacgaa

SEQ ID NO: 22714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaacaggtagcctcttgcacggtctcct

SEQ ID NO: 22715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaactggaggcagctcttcttcctaggc

SEQ ID NO: 22716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaagctgtccagtcggtacgtgtgcggg

SEQ ID NO: 22717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaatggttattggtgagacgggctagcg

SEQ ID NO: 22718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaatgttggctcaccgggtggtcgaggc

SEQ ID NO: 22719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacagacggtttagaccagctctccgaa

SEQ ID NO: 22720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacaggcaacgttgctgaccagtctggg

SEQ ID NO: 22721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacattgggggcatcgttaactggtttt

SEQ ID NO: 22722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacgcatgaatttctgctcaagatttat

SEQ ID NO: 22723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacgccgtaccgcaagggcgattgtaca

SEQ ID NO: 22724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacggaaccaggtaggaggcgggcgtgt

SEQ ID NO: 22725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacggcacttctgaagcattagacgagc

SEQ ID NO: 22726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctactcctccctgcacaaagttaccccgc

SEQ ID NO: 22727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctacttcattttcctatggcggatgtatg

SEQ ID NO: 22728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctagagcagacaccaggctagaacttttt

SEQ ID NO: 22729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctagcaccccatacggaatttaagccctt

SEQ ID NO: 22730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctagccaggatgaacagggtgctacgttg

SEQ ID NO: 22731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctagccttttcagatgtttgcaacgcttt

SEQ ID NO: 22732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctagctcgtatcttctggtcatgctctcc

SEQ ID NO: 22733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaggaatgatctggaggcggtgaagttc

SEQ ID NO: 22734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaggattctttgggacggtagggtgcac

SEQ ID NO: 22735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctaggggctagacgagttggtttcgctgg

SEQ ID NO: 22736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctatcgtcacgttggacattggcctgctc

SEQ ID NO: 22737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctatgacctgttagtccccaatccgacgc

SEQ ID NO: 22738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctatggttaccaatgtcagtccgctatat

SEQ ID NO: 22739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctattaatcgtagtggtgggctcggaatc

SEQ ID NO: 22740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctattacttgtatttccacctttttccgc

SEQ ID NO: 22741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctattggatttttgtttcacaattgcccg

SEQ ID NO: 22742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcaactcctacatctacacgtcgtcagg

SEQ ID NO: 22743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcaataggcaatgattttgcaggcacgc

SEQ ID NO: 22744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcacatgacccaagatgataatgctccg

SEQ ID NO: 22745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcacctgatagaagcagctagggtcagg

SEQ ID NO: 22746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcacgtctcattctcttcctgcgagtta

SEQ ID NO: 22747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcaggtcacccgtgcaaatcgggccaca

SEQ ID NO: 22748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcagtcgcgttttgtatctcggacgatg

SEQ ID NO: 22749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcatcagccgtaattcaaggcagcggag

SEQ ID NO: 22750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccaatacatacctccgagtatcctcga

SEQ ID NO: 22751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccacatcaaggagtattgcgcggtttg

SEQ ID NO: 22752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccaggcgaaatgatagtgctcgtgcgt

SEQ ID NO: 22753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccatgagtatacggtgcatatagcatc

SEQ ID NO: 22754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcccgcaatcgttagggagaacccgctc

SEQ ID NO: 22755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcccgtcaatctatcgggctcacagtgc

SEQ ID NO: 22756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcccgttacagatctgtgggtggtattt

SEQ ID NO: 22757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccgaatgggttcacttttcaattggtt

SEQ ID NO: 22758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccgacgcatgaattagcgtcgggatac

SEQ ID NO: 22759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctccgtttccttggattccccgcgcgtgg

SEQ ID NO: 22760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgaggcagatggtcgaatatcggcggg

SEQ ID NO: 22761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgagttaaacatttcctcccgagtccg

SEQ ID NO: 22762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgagttacagcggtttatttctgtttc

SEQ ID NO: 22763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgcaaacggcgtgggggttgtcagctc

SEQ ID NO: 22764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgcatcttaaaacattctgccattaac

SEQ ID NO: 22765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgccaacgattgacaggtacatgcaca

SEQ ID NO: 22766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcggcaaacacattcgactatcaacgtc

SEQ ID NO: 22767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgtcagatggggaatggatctgattgc

SEQ ID NO: 22768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcgttaccgcacacttggtagatccgcc

SEQ ID NO: 22769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctagactcatgcgtaggaaggccttgg

SEQ ID NO: 22770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctagggtccgggggcacacatccgacg

SEQ ID NO: 22771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctcctaaaatgggttggatatagagct

SEQ ID NO: 22772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctcggaactggtaacgtggtttatgct

SEQ ID NO: 22773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctctcctcagacaaccattgacctgcc

SEQ ID NO: 22774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctggattcgaaaactcatgcgtctcca

SEQ ID NO: 22775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctggggcgattggacatccgcaaagat

SEQ ID NO: 22776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctggggcttctatacgtatagtgttct

SEQ ID NO: 22777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctgtctgacgatatccgtcctcatcaa

SEQ ID NO: 22778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctctgtgaagtggggcacgatgtgtgacc

SEQ ID NO: 22779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcttaactatcaatgtaacattgagcgc

SEQ ID NO: 22780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcttctgtgggtggctgcaccgcgaacg

SEQ ID NO: 22781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctcttggcacttgggacgcccttgtttgt

SEQ ID NO: 22782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgaataacggtctcgtggactgcggtgt

SEQ ID NO: 22783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgacctagtcttgtgatctttggacgtt

SEQ ID NO: 22784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgacgtcgtttcgtaggttcgtctttgt

SEQ ID NO: 22785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgactttaaggagtttattttggtcacg

SEQ ID NO: 22786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgagtcctgccgctgcatgccaaccccg

SEQ ID NO: 22787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgagttgaccacttgctgcgataacatc

SEQ ID NO: 22788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgatgccaattgaacctgctttggtcga

SEQ ID NO: 22789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgatgtgtcttagttggattgtggctcc

SEQ ID NO: 22790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgattcactgatgacgtaggcccacata

SEQ ID NO: 22791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgattggttacgctctgacattcgtttt

SEQ ID NO: 22792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgcatcccgcgtgtcagcctgtttgcgg

SEQ ID NO: 22793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgccaccccaagttggtccgggtcacgc

SEQ ID NO: 22794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgcgactcgacagtcatgccttgctgat

SEQ ID NO: 22795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgcgatcaagtgtgtagcttcggcgagc

SEQ ID NO: 22796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgcggatagttttgtaacaccggtcagg

SEQ ID NO: 22797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgctaggcgattgacagtgctccttcaa

SEQ ID NO: 22798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgcttggttcgtcaatgagtcgatcggg

SEQ ID NO: 22799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggaaaccaaccgtaattggcttgttta

SEQ ID NO: 22800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggaaggtatcaggatgatctgggaatg

SEQ ID NO: 22801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggacacacacctttctcgtcataacag

SEQ ID NO: 22802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggagactggttgatcccgcttgcgctt

SEQ ID NO: 22803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggatttccgtgggtatcccggtctgtg

SEQ ID NO: 22804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggcaatacgaagttgcggtgatttgta

SEQ ID NO: 22805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggcatcgcctgatcacgtccggaagtc

SEQ ID NO: 22806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggctaataacagtcttgtccattagct

SEQ ID NO: 22807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgggaggaacaggacgggggtggtggag

SEQ ID NO: 22808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgggcaatccgtttagcatgccgcgggc

SEQ ID NO: 22809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgggcgcgcatctctctatcagtgctcg

SEQ ID NO: 22810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggtaagcatgaaatattgactgtcacg

SEQ ID NO: 22811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggtcactgtaggcttggcgaaaggctg

SEQ ID NO: 22812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggtcgaccatgcattgaagattttcca

SEQ ID NO: 22813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggttataaagtatcaggtacgttggtc

SEQ ID NO: 22814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctggttctacgcgtcccgcgatttagatg

SEQ ID NO: 22815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtatctctgtggtgttcacattagtac

SEQ ID NO: 22816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtatgccggtgcattaatcctatcgta

SEQ ID NO: 22817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtatgttttcgtacggtgtcctgatgg

SEQ ID NO: 22818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtccttgcgtcaatataatagcaagtg

SEQ ID NO: 22819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtggtcttcaggcttgcgttcgatcac

SEQ ID NO: 22820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtttagcacgcccggggttaggctcgc

SEQ ID NO: 22821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctgtttccgagacgttttttcttcacact

SEQ ID NO: 22822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttaagcataccaccgctgtcttcaagtt

SEQ ID NO: 22823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttacatcccgagcgttatccctgacgag

SEQ ID NO: 22824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttacccgtgcaccaggtggtatctccgc

SEQ ID NO: 22825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttactgtatgttcaggctgtttaaagct

SEQ ID NO: 22826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttagacgcgctgttatctacaggttgcg

SEQ ID NO: 22827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttagcgagttacggtatatgggccgaga

SEQ ID NO: 22828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttatctagggtcgcgtgccgcgccggga

SEQ ID NO: 22829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttcccagttccgtaactgataatccgcc

SEQ ID NO: 22830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttccgaaaccttctcgcggtactgacgt

SEQ ID NO: 22831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttcgtgtttctgaggcatgccgtagcgc

SEQ ID NO: 22832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttctaccttaatcgctgcacaccgccaa

SEQ ID NO: 22833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttgacgtcatcgttcccctgccgccctc

SEQ ID NO: 22834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttgagcacgtctcggacatcatatgtta

SEQ ID NO: 22835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttgcgtgggggaaactctcacttctcaa

SEQ ID NO: 22836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttggtcgtcaccaacagatagctttctc

SEQ ID NO: 22837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgcttgtcgacgcgttatgtagtcaatgtcg

SEQ ID NO: 22838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttatgcaaggagagtaggttgtgggaa

SEQ ID NO: 22839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttatggggctcgatcacttaagggtgc

SEQ ID NO: 22840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttcgagtttttagccgtcttaggtaac

SEQ ID NO: 22841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttgccctcctatgtcagtcccacgaga

SEQ ID NO: 22842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttgttatcatcagtgtgtctgaggatt

SEQ ID NO: 22843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttttacggtgtcctaaggttgcactct

SEQ ID NO: 22844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttttgcacggtatgaaggacgctgctc

SEQ ID NO: 22845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgctttttggtatgttaggttttttttatat

SEQ ID NO: 22846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaaaatctctcttatctgtgctgacagc

SEQ ID NO: 22847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaaaattcaaatgtaactgtgggttgtc

SEQ ID NO: 22848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaaatatcaatgaaactgttgcagccgt

SEQ ID NO: 22849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaactatgtcttggcgtagagcggatga

SEQ ID NO: 22850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaagccatcctcttgtcgttgtaagtgt

SEQ ID NO: 22851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaagttgggatctggacgcgccgcactt

SEQ ID NO: 22852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaacaacggtttggagacctttgtagctg

SEQ ID NO: 22853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaacaccaactgatctgcgaggtcttcgc

SEQ ID NO: 22854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaacgagatgtacgatcgaatcttgtgtg

SEQ ID NO: 22855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaacgatgctggtaacagagcgcgtgttt

SEQ ID NO: 22856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaacgctacttctttacacatcgcctcgt

SEQ ID NO: 22857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaactccgcgcctggtcttacgaggttcg

SEQ ID NO: 22858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagaaggattccttgaaacaatgctttg

SEQ ID NO: 22859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagaggcgccactgacacgctgcaaccc

SEQ ID NO: 22860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagaggtctagagcttggggtccggtgg

SEQ ID NO: 22861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagataagcagtttaaccttacgaaccg

SEQ ID NO: 22862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagatgcatggcttcgtttattagcact

SEQ ID NO: 22863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagatgctagccacgatgcagatgggcg

SEQ ID NO: 22864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagcacgcacagtcattatagcgtaggg

SEQ ID NO: 22865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagccggagctctcgttgctagtgtccg

SEQ ID NO: 22866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaggccggacggatggacgggtctgtgc

SEQ ID NO: 22867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaaggggttcacgggctgaacttgttatt

SEQ ID NO: 22868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagtcgaaggtagctttcggtgcattta

SEQ ID NO: 22869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaagtgcgcgtggggtgtatttttgcatt

SEQ ID NO: 22870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatagagtcgctaggtcttgattgtaac

SEQ ID NO: 22871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatccgcccgttagatgtctgtgggggt

SEQ ID NO: 22872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatccgttggtgcgagcaggttctgcgt

SEQ ID NO: 22873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatggtactgtacacgctcgattactgt

SEQ ID NO: 22874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaattaggtgtttattgacagtgatgata

SEQ ID NO: 22875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaattctcagcctttccagtggtggtggt

SEQ ID NO: 22876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatttgaaccccttcgttgtgcagtaaa

SEQ ID NO: 22877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatttgtgacacacgagatagggccggc

SEQ ID NO: 22878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaatttttttcaattcaaagatcattttt

SEQ ID NO: 22879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacaagctttgatggattctatcttttat

SEQ ID NO: 22880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacaagttctatgacggattaggtactgg

SEQ ID NO: 22881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacaatccacgtagtacttgcatgtggcc

SEQ ID NO: 22882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacacgaacagcttctacacccattgtaa

SEQ ID NO: 22883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacactgcacgtccaagcacccctgtact

SEQ ID NO: 22884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagagtacgtagagtggcggacatgcc

SEQ ID NO: 22885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagatgtgggtggtttagcccggtagg

SEQ ID NO: 22886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagcaacgctaggcttggtactgcttg

SEQ ID NO: 22887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacaggcgataacacggtcaagtagtcgg

SEQ ID NO: 22888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagggatcataggaccagccgttcgta

SEQ ID NO: 22889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagtgattcccgtggtttaccacctgg

SEQ ID NO: 22890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagttaccgcgccctattggataacgt

SEQ ID NO: 22891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagttattgcgtattcagctttactca

SEQ ID NO: 22892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacagttgtgcctagtatgtcacgtttag

SEQ ID NO: 22893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacatatttaggctgcccgttattcttat

SEQ ID NO: 22894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacattagtaggcacacttactcatttgc

SEQ ID NO: 22895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccactagacggcagcttcacctaaaag

SEQ ID NO: 22896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacccctcaatctaggtcagtcatcggag

SEQ ID NO: 22897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacccctgcagtgtatctagcgagccggt

SEQ ID NO: 22898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgagtctttcatcccagagaacggta

SEQ ID NO: 22899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgcaaacatctgcgtgatatggagct

SEQ ID NO: 22900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgcaactcttctggctgatcatcttt

SEQ ID NO: 22901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgcgcgccctgtctcggctgtggtac

SEQ ID NO: 22902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgtgcgttcttagtgcccattttggg

SEQ ID NO: 22903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccgtggccacatcgctcgcgataataa

SEQ ID NO: 22904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacctccaaattgtagagtcactccgtac

SEQ ID NO: 22905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaccttggtgcgggtccccaacgttgtat

SEQ ID NO: 22906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacctttcagaaccgttattcgggcttgt

SEQ ID NO: 22907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgaaaaggggtcaccccaggcgtgcgc

SEQ ID NO: 22908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgacaggcttgtgcaggcagtttctcg

SEQ ID NO: 22909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgactgccccgtgaataggtcgacgtt

SEQ ID NO: 22910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgatgcctgcttctcactagagacgag

SEQ ID NO: 22911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgcatggacgaatcgaccttacgctta

SEQ ID NO: 22912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgcctaagaggcaagccagatcgcttg

SEQ ID NO: 22913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgcgcgagccgaaacgagttgtatgga

SEQ ID NO: 22914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgctgtatcgccatcaacactgtgctc

SEQ ID NO: 22915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgggcaaggtgcgagcagaaatggtgt

SEQ ID NO: 22916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacgggctgtctcgtcgtttagccatcac

SEQ ID NO: 22917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacggggcttcttacacacatgaggccgg

SEQ ID NO: 22918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacggttggcatttccgttcccctcgcgg

SEQ ID NO: 22919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggactcgaatccgactgcattgccagcaac

SEQ ID NO: 22920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggactcgtttgtctccgttaaattcagtac

SEQ ID NO: 22921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggactctccacgatgggtgtcatgctaggt

SEQ ID NO: 22922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggactgaattgcggttcaaggggatgggac

SEQ ID NO: 22923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggactgtgtcgtttcattcgtgacctcgtg

SEQ ID NO: 22924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggacttgcggtctagcattgtgctattgcg

SEQ ID NO: 22925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagaaagcaaaggatccccttacgggcga

SEQ ID NO: 22926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagacgctcagtttttctgcgtagtaccc

SEQ ID NO: 22927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagagaccagatccagccgttttgtcgtc

SEQ ID NO: 22928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagagcgtgggcgcctcgcaagcgggcat

SEQ ID NO: 22929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagagggatattaccattcttgcactggg

SEQ ID NO: 22930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagaggtacttgttgaagatgcactggac

SEQ ID NO: 22931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagattaccctatttcaatttgttgtacg

SEQ ID NO: 22932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagattagaacggcgggtcggcccaggct

SEQ ID NO: 22933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagcaaaggccagggttttactttatacc

SEQ ID NO: 22934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagcagcgccgtgggttaaacatagcgcg

SEQ ID NO: 22935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagcagtgtggagttttgggtatacctgt

SEQ ID NO: 22936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagcataagggagcttgggcaacttgtgc

SEQ ID NO: 22937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagccacacgagttagagatcgcgagccc

SEQ ID NO: 22938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagccagttgcgcacttgtcggtccattg

SEQ ID NO: 22939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagcgtagggtacgccgttcacggtcgtc

SEQ ID NO: 22940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagctatctcatttattttgggcaagatg

SEQ ID NO: 22941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagctgaggatgcgcgtgtattgacaacg

SEQ ID NO: 22942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagctgcaaaagcgcgttatggtagttac

SEQ ID NO: 22943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggacatctagattattacgcgaagggg

SEQ ID NO: 22944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggcaatccaaggacaatgctgggtatt

SEQ ID NO: 22945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagggactggggctgcgcagtagctaatg

SEQ ID NO: 22946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagggcggtgagtactggtctgcgctagg

SEQ ID NO: 22947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggggatagctcggtgttcccagtgata

SEQ ID NO: 22948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggggttcgactggtgtggagttgggcg

SEQ ID NO: 22949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagggttttggctcgcgatttttggggcg

SEQ ID NO: 22950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggtaatggactggggtatcgagttttg

SEQ ID NO: 22951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggaggtcagcattctgggcgaagggttaca

SEQ ID NO: 22952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtcaagcggacggagatgtccatgtgt

SEQ ID NO: 22953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtcctgtactggtttacctcttcgaat

SEQ ID NO: 22954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtgagtagaagacgaccaaagcgcggt

SEQ ID NO: 22955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtgcgctcgcgtggttggtggtgggcg

SEQ ID NO: 22956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtggacaagcggaatacaggcatcggt

SEQ ID NO: 22957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagtggacgcgtcaacggctcatgtctcg

SEQ ID NO: 22958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggagttggacacctggcctgcttatgtagt

SEQ ID NO: 22959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggataaaccgcctactggtttggtccacat

SEQ ID NO: 22960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggataacttccgtctgcgcatggtggtatg

SEQ ID NO: 22961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggataaggggaaatatcgggcagcgatggg

SEQ ID NO: 22962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggataattcttccttgcgctttcttcagcg

SEQ ID NO: 22963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatacagttgagatgatgacccggtgcga

SEQ ID NO: 22964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatacccagttctaccaaccagcgccgtg

SEQ ID NO: 22965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatagggtagatgtcgaccttggaagggg

SEQ ID NO: 22966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatagtatacgccgactgacctgtgcatt

SEQ ID NO: 22967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatagtcacggtctttccatagcaccgtt

SEQ ID NO: 22968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatatgagaatttcgatttatttcttaca

SEQ ID NO: 22969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcaacatgagtgagttgggagcacggg

SEQ ID NO: 22970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcagcggggctactctaacggcgtgtg

SEQ ID NO: 22971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcataccggaaaaagatgtcttggttt

SEQ ID NO: 22972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatccactacggttagggagttctcagcg

SEQ ID NO: 22973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcctcatttagaagggcgggggcgggt

SEQ ID NO: 22974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcctgggagcaggtgccattgtggcgg

SEQ ID NO: 22975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatcgagtccattagatcgcataacccat

SEQ ID NO: 22976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatctacaaggtggctacaggtccttacc

SEQ ID NO: 22977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatgaggctccgtggggtacagactttac

SEQ ID NO: 22978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatgctgtcgagtgcagcgcgctacttag

SEQ ID NO: 22979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatggaacgcgcgcgattatcgaacggat

SEQ ID NO: 22980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatggaacggcgggattcccagagcgccg

SEQ ID NO: 22981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatggcagtgacgggctctgcagtctgcg

SEQ ID NO: 22982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatggtaccggggacgggatatatgggcc

SEQ ID NO: 22983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatgtcaataggccagtttaaagccgcac

SEQ ID NO: 22984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggatgttcaggagttgggtactgtgtctat

SEQ ID NO: 22985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattaatacttttagtgggtgactgctgc

SEQ ID NO: 22986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattcgatgcgcacgtagtctgctcataa

SEQ ID NO: 22987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattctattcacctgatttaaagccatca

SEQ ID NO: 22988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattgcagacccttagtggtgcggtttgg

SEQ ID NO: 22989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattgttcggggcttcgcgctatgtggtc

SEQ ID NO: 22990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggattttctggaactaatatgatgtcatcc

SEQ ID NO: 22991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaaaagggaggcagttcgtccagtgttt

SEQ ID NO: 22992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaaatcgcgaggcatgatttgactggga

SEQ ID NO: 22993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaacaaacactatgtactcacgaattca

SEQ ID NO: 22994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaacagacccgacttttatcttcgcatc

SEQ ID NO: 22995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaaccggaagtacactggggctgctcgg

SEQ ID NO: 22996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaacgaatcgcatgcctgtctcgcatca

SEQ ID NO: 22997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaacggtctggtgcagttttggtgggtt

SEQ ID NO: 22998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaagagctgacatacgtgtgtgcgggcg

SEQ ID NO: 22999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaaggtactcgaatcttagaagccccgg

SEQ ID NO: 23000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaagttttcccacaagtcatgggcgggc

SEQ ID NO: 23001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaatagaggtcctaaattgcgggcgtga

SEQ ID NO: 23002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaattatactcgtgtcgcgaaccagggt

SEQ ID NO: 23003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaccatctttctctggacgttgcttgga

SEQ ID NO: 23004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaccgccagggaactgacacgggtgtgg

SEQ ID NO: 23005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaccgtcattctccaaccggcatgacgg

SEQ ID NO: 23006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaccgtgtacgtttatacctgagcgttt

SEQ ID NO: 23007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacctgggaaccacgagttccacgaact

SEQ ID NO: 23008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacgcgcaccgagtatcgtaggctccac

SEQ ID NO: 23009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacggaagagctgctcatacaagtgcgg

SEQ ID NO: 23010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacggagcgaggtgtacgagtaaacgcg

SEQ ID NO: 23011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacgtatcgggggtttcgctcttttgcg

SEQ ID NO: 23012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcacgttagcccgattgtctcgcttatag

SEQ ID NO: 23013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcactagggtcttcgaacacagggaagct

SEQ ID NO: 23014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcactggttcgatcgttttcctcgttggg

SEQ ID NO: 23015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagaaagacccacatgacggtgttccat

SEQ ID NO: 23016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagacacacggggaattttgacctgcgg

SEQ ID NO: 23017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagaccaggggtgcgtgggttcgtgtcc

SEQ ID NO: 23018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagcaaacgctccttgctgctgtggtat

SEQ ID NO: 23019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagcgcccgggaatcctcatagttgccc

SEQ ID NO: 23020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaggatcgttgcttaagtcggagtttta

SEQ ID NO: 23021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaggcgtgaagtttgatgccatgaacgg

SEQ ID NO: 23022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaggcttcaagggaccaccccctgacgc

SEQ ID NO: 23023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcaggggttctcattcgtacaccacgtcc

SEQ ID NO: 23024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagtacattgtggtaccgcgtctccccg

SEQ ID NO: 23025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagtagacgataggggggtgcatccggt

SEQ ID NO: 23026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagtcaggagttgtgcaggcggaaactg

SEQ ID NO: 23027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagtcgcgcacctatagcggaggtatga

SEQ ID NO: 23028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagtgccttagaagtgtgtgagctgcaa

SEQ ID NO: 23029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagttgcgctcagagcccgtgtgccagg

SEQ ID NO: 23030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagttgggtgtacgaaatcgaccatggg

SEQ ID NO: 23031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcagttttctaggaaatactaaacgtctg

SEQ ID NO: 23032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatcacgagagcggtcactgcgagcgcg

SEQ ID NO: 23033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatcatacaaagtatcattattcgccta

SEQ ID NO: 23034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatcgaatgagcacattgtttgcactat

SEQ ID NO: 23035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatctagactttaaatacgtggcttaaa

SEQ ID NO: 23036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatctcgacaagggcggtatcagattcc

SEQ ID NO: 23037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatgaactgcgcattagatcgacccccc

SEQ ID NO: 23038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatgcggtgcggcagagagacgttgtag

SEQ ID NO: 23039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatgtcgttcgggccctcacggtgggga

SEQ ID NO: 23040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcatgtggtcacaagaggcatgtccagat

SEQ ID NO: 23041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcattctggcagtgtgctatggtgcatgg

SEQ ID NO: 23042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcattgcatcgcgcagggctttgtatgat

SEQ ID NO: 23043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccaaacccgcttctaaacgccctgtcgt

SEQ ID NO: 23044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccaaactctaattaccgctccctcccgc

SEQ ID NO: 23045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccacagagctggcaaatgctgcgtttct

SEQ ID NO: 23046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccacgcatcgcacgctggaagaatgcct

SEQ ID NO: 23047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccactcgtgatacctctgcgccccttcg

SEQ ID NO: 23048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccactttctgtgttcctctgtcttgaga

SEQ ID NO: 23049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccagatgtaggctcgcgattcgggtgta

SEQ ID NO: 23050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccaggctgttttgcggaatagcgcagca

SEQ ID NO: 23051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccatccacgcatatcggtaacgggatca

SEQ ID NO: 23052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccatcggtatcctcagcagagtaacctc

SEQ ID NO: 23053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccaactgtttttattactctcggtggt

SEQ ID NO: 23054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccacctaagctcttacctggaggcgtg

SEQ ID NO: 23055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccaggacactattgcaggctgggtgct

SEQ ID NO: 23056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccgagactttcccaataaccggttggt

SEQ ID NO: 23057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccgatctctatccgacacacatgtggt

SEQ ID NO: 23058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccgccatttcgttagtgtcagacaggt

SEQ ID NO: 23059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcccggtctaccgcattgatgcggatatc

SEQ ID NO: 23060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccctccaatcgatctggatcgcatgtgg

SEQ ID NO: 23061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccctcgattgttgacctcgcgttggggc

SEQ ID NO: 23062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgaataggtaaagagaagttggatagg

SEQ ID NO: 23063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgacagtgtaaagcgcgccgtgcgtcg

SEQ ID NO: 23064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgacgcttcgtagatggctatctggca

SEQ ID NO: 23065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgcacggaggtgattaggtggctctcg

SEQ ID NO: 23066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgccgctgttctcgatatgatgtgaac

SEQ ID NO: 23067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgccggacactccactggttcgtacgc

SEQ ID NO: 23068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgcgtgtttgaataatccgttcatgat

SEQ ID NO: 23069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccggatggacgctggctaacttgtgtac

SEQ ID NO: 23070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccggatgtcttttggaggctgcttgggt

SEQ ID NO: 23071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccggcatcattctgatgatgataaattt

SEQ ID NO: 23072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgggcgctcgggtatttcgaacatgtc

SEQ ID NO: 23073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccggggcgttattatatttgcggcactg

SEQ ID NO: 23074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgggtcggtactgagcgtaagtgcgtg

SEQ ID NO: 23075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgtatcattaacgtcgatgaaagatgg

SEQ ID NO: 23076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccgtcgtaaccgcatcccagtctcctag

SEQ ID NO: 23077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcctaggacaacatagggctcgtgtcttt

SEQ ID NO: 23078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcctcaagatcgctgcctaccgcggtgcc

SEQ ID NO: 23079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcctctacgacgatactcgctagcactag

SEQ ID NO: 23080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccttaggtttctatccgcctctgtgtcg

SEQ ID NO: 23081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggccttgccaggtaccacgccatcaggggg

SEQ ID NO: 23082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcctttttgtcattactgatctatctgga

SEQ ID NO: 23083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgaaacgtcggagtcctatgtcttgggg

SEQ ID NO: 23084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgaacatgggatcgggtcaggatcgtga

SEQ ID NO: 23085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgaagatagatggcattaggcatgggct

SEQ ID NO: 23086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgaagcgaagcacgcaactgactagttg

SEQ ID NO: 23087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgacttgtcagtggtaaatcgagggctc

SEQ ID NO: 23088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagacacatcactggtgggtgggctgg

SEQ ID NO: 23089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagagggagcagtcgtcgtgtctagcg

SEQ ID NO: 23090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagcaaggaaggtaatcgtaagctcga

SEQ ID NO: 23091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagccatagcccggtacaccaggggcg

SEQ ID NO: 23092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagcccttaaagagttaactcgggtat

SEQ ID NO: 23093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagctggctgtgttcaatgaacgcatg

SEQ ID NO: 23094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagtctatttcatgaacgagatctttg

SEQ ID NO: 23095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgagtgatgtgggtatgaagcagttcgg

SEQ ID NO: 23096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgatgaggaacggcatacccccctgatg

SEQ ID NO: 23097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgatgctccggtgcagtttggtggttgt

SEQ ID NO: 23098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgattatatagctaggagttctggtata

SEQ ID NO: 23099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcaaaccctatgttaaacagttgttga

SEQ ID NO: 23100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcagcgacagcaacgttacgtctgtca

SEQ ID NO: 23101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcaggggttacccgttgtctggtatcg

SEQ ID NO: 23102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcagtaatagggacgttccatgaacgt

SEQ ID NO: 23103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcatcccgttatcaagtaccccaagcc

SEQ ID NO: 23104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcatgaaggctaatcaggctgactcaa

SEQ ID NO: 23105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgccgaaggcatcaatcaagggaccggt

SEQ ID NO: 23106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgataccgttcggggcctgtgcatcg

SEQ ID NO: 23107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgatagtaaagactaaactattcaag

SEQ ID NO: 23108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgctttcattcagtatccacggcctg

SEQ ID NO: 23109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcggggattcaggcgtatgcttcacaa

SEQ ID NO: 23110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgtgcatgctgatcgttgggcgtggg

SEQ ID NO: 23111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgtgcctcgtgtttacctgcgtgtac

SEQ ID NO: 23112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgcgttttagatttcacaaatgctgtac

SEQ ID NO: 23113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgctggcacatctatatgggccctaccg

SEQ ID NO: 23114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggaaagttacgtcgagtcacacggtcc

SEQ ID NO: 23115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggaatcgaaggtattcactcatgggtc

SEQ ID NO: 23116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggacatggatgcatgacgtagcgcaac

SEQ ID NO: 23117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggacgcatttcaaagaacggattgggt

SEQ ID NO: 23118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggagagattgaagtcgaggagtcaccg

SEQ ID NO: 23119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggagctccacccggtaatcctggaact

SEQ ID NO: 23120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggagggaaacagacgcgagtccttgtc

SEQ ID NO: 23121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggcacgaaatgcgcatccatgtgatga

SEQ ID NO: 23122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggcgacttattatggttagtgcagtcg

SEQ ID NO: 23123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggaccgaaacacgatctctcttgttc

SEQ ID NO: 23124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggaggatcccgggatcgctatcattt

SEQ ID NO: 23125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggcggagcatcggttgtgcctcggac

SEQ ID NO: 23126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggctttgttctcatcctagttgagca

SEQ ID NO: 23127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggggctgcggcatgcaaccaagaacgg

SEQ ID NO: 23128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggggatataaacgtatctagctaaca

SEQ ID NO: 23129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggggtatgttacgggccgcttatatg

SEQ ID NO: 23130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggggtaattgtttcgttgcgttcgcca

SEQ ID NO: 23131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggggtaccaaatctagaggtcaggggc

SEQ ID NO: 23132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtacgcttggtcgcgaagagcaact

SEQ ID NO: 23133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtaggtaactactctttacgggtct

SEQ ID NO: 23134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtatgtgacgtccttacatcgggcg

SEQ ID NO: 23135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtcgactacatggcaacctatggac

SEQ ID NO: 23136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtgctgtaagatcattccgagcgtg

SEQ ID NO: 23137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggtgtatccgcgatagtcgtgttcat

SEQ ID NO: 23138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgggttctcgcggatgtatgtatcgcgg

SEQ ID NO: 23139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggtagacatctgctacgccaatcgggg

SEQ ID NO: 23140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggtcccctttgtaacgcgtgtgatcct

SEQ ID NO: 23141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggtggctacggctttgacgtgccagtg

SEQ ID NO: 23142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggttccaaagcatgacagctctacgca

SEQ ID NO: 23143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggttgtcaagccctaggtaggccttag

SEQ ID NO: 23144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcggttttcaaagggtgacaagtgatgcg

SEQ ID NO: 23145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtacgaccgctaactcgcctcgatcgg

SEQ ID NO: 23146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtacggggctgtaagtcgggcgagctg

SEQ ID NO: 23147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtaggcgtgacacgtgtgggctgctgc

SEQ ID NO: 23148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtagggtcgggtccgttggttcaagca

SEQ ID NO: 23149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtccagtaggtagtcaggacctcaaag

SEQ ID NO: 23150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtctacagaacgtgttgaggggttgca

SEQ ID NO: 23151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtctcggtgtctctggattgggaagtc

SEQ ID NO: 23152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtgacccgtttttgagcctcgacgggg

SEQ ID NO: 23153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtgatcattctataccccgatggcggg

SEQ ID NO: 23154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtgtgattcatatcggagagctgatgt

SEQ ID NO: 23155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgtgttcacgagtcccaattgcagcgtg

SEQ ID NO: 23156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgttaggtaggcaaatctgacccaggtt

SEQ ID NO: 23157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgttctggagtacgcgagtttatgcaaa

SEQ ID NO: 23158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgttgcgaggtgttgctcactgggacgt

SEQ ID NO: 23159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcgttggtgagataatggcccctgtcccg

SEQ ID NO: 23160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctaaaactaaagggtacgacgagatgca

SEQ ID NO: 23161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctaaaccagagtcgttgcattggtcgcg

SEQ ID NO: 23162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctacaagaacgccaaaccgatcgaaaca

SEQ ID NO: 23163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctacactacctatgtcgtcaggtcgggt

SEQ ID NO: 23164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctacctgctgaaggttttctaggtttac

SEQ ID NO: 23165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctacctttacagacactcgggctactgg

SEQ ID NO: 23166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctacttatgttgacttattggtctcgtt

SEQ ID NO: 23167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctagctgggaggcattttccgtacagac

SEQ ID NO: 23168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctagctgggagggcgcaggaacgttggt

SEQ ID NO: 23169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctatcacgtaaggctgtcgtttgtttta

SEQ ID NO: 23170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctatgtaatcgcccgatttgtgaagtcg

SEQ ID NO: 23171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcaactgtttggagagtcatcaaatcg

SEQ ID NO: 23172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcaatcaggtgtgagtggcagcattag

SEQ ID NO: 23173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcacgtgtggactgaacttaattgcgc

SEQ ID NO: 23174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcagtttgcatactgcacacttttatg

SEQ ID NO: 23175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctccatctgtcttacgaggttatacttt

SEQ ID NO: 23176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctccccactacatcttgccacgaccttc

SEQ ID NO: 23177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcccgacgttcacatgttaaggaaccc

SEQ ID NO: 23178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctccgacaggtaactacaccgttcgtca

SEQ ID NO: 23179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctccgtagacccgtgcagcagttgcttt

SEQ ID NO: 23180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcctcaagtgactaccggctagggctg

SEQ ID NO: 23181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcgcccgggattcacaacagttcgcgg

SEQ ID NO: 23182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcgtattcattatggcaccccgttatt

SEQ ID NO: 23183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcgttcgtcttttgttaaagggtggca

SEQ ID NO: 23184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctctcacgatgggtcccaaacaaaggtc

SEQ ID NO: 23185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctctgtcacgctggcacatgtctaacgg

SEQ ID NO: 23186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcttacccgtattctgccacacttttg

SEQ ID NO: 23187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctcttgatcgttcgatgtttcccggagc

SEQ ID NO: 23188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgaacaggttattggcggatcgagttc

SEQ ID NO: 23189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgaactccgatgtttaggactgcatag

SEQ ID NO: 23190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgaatatgtgcagatcttgtccatagg

SEQ ID NO: 23191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgaggaagcgtgtacgggcatgacctc

SEQ ID NO: 23192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctggacggctaagctaccccggataagg

SEQ ID NO: 23193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgtgcatacgttggtcctcccccggga

SEQ ID NO: 23194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgtgcgcatgaccccgtggtaggtatc

SEQ ID NO: 23195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctgttccgggggtaggttagtcccgcta

SEQ ID NO: 23196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttaaacgagtacatttctgttgtatcg

SEQ ID NO: 23197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttaaacggatctccctggatattcgtt

SEQ ID NO: 23198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttcctagtaaagcatattcccaacgtc

SEQ ID NO: 23199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttcgcgtggaggtgttcttgatttttg

SEQ ID NO: 23200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttcgtaggcgcaagcatggtaggcttt

SEQ ID NO: 23201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttggatagtcgcaccacccgatgatcg

SEQ ID NO: 23202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttggatggacccctgagagaaggtcac

SEQ ID NO: 23203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttgtgcggagagtggggaaacgggcct

SEQ ID NO: 23204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctttaccaaaggcacttggtgacgaaga

SEQ ID NO: 23205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctttggctatcgtaaatgggtcgttcgc

SEQ ID NO: 23206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggctttgtgtaacatgactgggcggaatcg

SEQ ID NO: 23207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttttctttggttgggcgttacctcatg

SEQ ID NO: 23208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggcttttttgtttgcgtgtcctaacagggg

SEQ ID NO: 23209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaaactggctacttaagcggtagtgtgc

SEQ ID NO: 23210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaacacggcgagagactgctcatacggc

SEQ ID NO: 23211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaacgtatacgctaatgctagtcggtgt

SEQ ID NO: 23212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagaggggatgtaggtcggagaggtaa

SEQ ID NO: 23213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagagtgacaaggagattcatacgccc

SEQ ID NO: 23214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagcacacagtcggtctctctcaggcg

SEQ ID NO: 23215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagcgagcctgtaagggcgttatgcgt

SEQ ID NO: 23216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaaggcgggaggacccctatccagacca

SEQ ID NO: 23217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagtcgcggcgccgtgggtgtgggaca

SEQ ID NO: 23218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaagtgggttatttgtcgtagatagcgg

SEQ ID NO: 23219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaatcggcacttttgttccacgtaccta

SEQ ID NO: 23220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacatgcgtcgccagaattttccaccga

SEQ ID NO: 23221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaccaatgtgacttataatgaaccagtg

SEQ ID NO: 23222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaccacttaatataccgagttgccagcc

SEQ ID NO: 23223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacccagctcgtgctcctagcccgacca

SEQ ID NO: 23224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaccgcacaccatgggtccgccgaatga

SEQ ID NO: 23225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaccgcggaaacgagtttgcatttggac

SEQ ID NO: 23226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacctttgtctgatgtatactatcctgt

SEQ ID NO: 23227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgaagggtgactttgcgccccgaatt

SEQ ID NO: 23228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgatgattggtagcggggggacgcgc

SEQ ID NO: 23229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgccgggcatctgatgggggccgatg

SEQ ID NO: 23230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgcgaggactggaggaattgtacccg

SEQ ID NO: 23231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgctaatgagaggcactgggtagttt

SEQ ID NO: 23232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacggcgcggttgtttggttgtgctact

SEQ ID NO: 23233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggacgtaccgcaacatgatgggaggcagt

SEQ ID NO: 23234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggactactagatgaagccgatccagtgtc

SEQ ID NO: 23235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggactcgaatacgtttggtactgcgttac

SEQ ID NO: 23236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggactgttctccgtgggtcaaaaccgcca

SEQ ID NO: 23237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagaatgggaggcggtgctcttgggcgc

SEQ ID NO: 23238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagaccagcgtatatgtcatattcggcg

SEQ ID NO: 23239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagcgcacataccttctgccatgacgca

SEQ ID NO: 23240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggaggatgagcgtggtgcaaccgcttgat

SEQ ID NO: 23241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagggaatcagaatgcgtaggttaccgt

SEQ ID NO: 23242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagtaacgtcccttctccgtgtgccttc

SEQ ID NO: 23243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagtactgttttattcaggtaacatctt

SEQ ID NO: 23244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagtagcatcatgtgtgggctgtaaggg

SEQ ID NO: 23245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggagttactactggcacagaaaacgccct

SEQ ID NO: 23246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggataaacatttctcgagaacgtcagcgg

SEQ ID NO: 23247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatacgactcaacctaggtggctcgttg

SEQ ID NO: 23248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatcaagggctatggcgggacgtggtgc

SEQ ID NO: 23249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatcagtatgtcaagtctcttctgttgg

SEQ ID NO: 23250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatctgtcagtttgctgcacacgcctcg

SEQ ID NO: 23251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatgcgtcacccacggtcaacctgtaga

SEQ ID NO: 23252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatgcttatgcggaatttgctggcaggc

SEQ ID NO: 23253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatggaaggataataggttggccgctct

SEQ ID NO: 23254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatggagcgtcgcagagttggtttgctg

SEQ ID NO: 23255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggatgtcgactcggttccttcttataagg

SEQ ID NO: 23256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggattcattcattgatagcatgctgttta

SEQ ID NO: 23257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggattgctgtttgtcattcgagcccgccg

SEQ ID NO: 23258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcaaatgcgatgtgtgatggaggtagtg

SEQ ID NO: 23259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcaacaggcacagtcttgggtcgtgtgc

SEQ ID NO: 23260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcaaccttgtgggtatccgttcgagtgc

SEQ ID NO: 23261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcaagacggtgcggacgggaggagtcct

SEQ ID NO: 23262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcaagcctcatttcccctgcagcccatc

SEQ ID NO: 23263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcacaacttgtttacctggcgtcatttg

SEQ ID NO: 23264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagaaacggtcgctctcggtgctggcg

SEQ ID NO: 23265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagaaataggactgtcatcgtgggtgc

SEQ ID NO: 23266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagaccccaccattcagctgtttgact

SEQ ID NO: 23267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagagggcctggacacgcaatgacctg

SEQ ID NO: 23268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagcaactgctatggagggtacatgta

SEQ ID NO: 23269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcagggggttgcgcataacgacgggtgc

SEQ ID NO: 23270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcatagcagctctgaagggaatccaaga

SEQ ID NO: 23271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcatcgcgtagccgggttctggtgtccc

SEQ ID NO: 23272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccacgagcggtactagcaagcctcacg

SEQ ID NO: 23273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccatctgacccagactgggagtatggt

SEQ ID NO: 23274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcccattcaatagcttgtgagatcgtcc

SEQ ID NO: 23275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcccgctggttctccgctatgttgctgc

SEQ ID NO: 23276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccgcgtacatattactgtggccacaga

SEQ ID NO: 23277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccgctacggatatagtccgagtgttac

SEQ ID NO: 23278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccggcgcaccccgcagtgctcgtgttt

SEQ ID NO: 23279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccgtcgaccgtcgaaccgcatcttgca

SEQ ID NO: 23280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcctccagttccgccgagattccgcggt

SEQ ID NO: 23281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggccttgggggcggttccgtgatcgcaca

SEQ ID NO: 23282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgaagagaggtcggacaatacgttacg

SEQ ID NO: 23283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgaccaggaaacttagaggccacatgg

SEQ ID NO: 23284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgagagtgcttctttacggctgcatat

SEQ ID NO: 23285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgaggcgtggtaatgggtctccggttt

SEQ ID NO: 23286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgagggctgcgcaccgtgtttacagcc

SEQ ID NO: 23287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgatcagggacaaggtgcggagtccac

SEQ ID NO: 23288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgatgattgggcctacgaggtggttgc

SEQ ID NO: 23289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgcagggtctgtatttgccagcttggc

SEQ ID NO: 23290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgcatcctgcttgttcggcgcgggata

SEQ ID NO: 23291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgcgagagtatgaacaggacaagtggg

SEQ ID NO: 23292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgcggatgccaactattccaacttcgt

SEQ ID NO: 23293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcggaatacgacacaccctcggatactg

SEQ ID NO: 23294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgggaggttgtgcattctaggagcggc

SEQ ID NO: 23295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcggggggtcgaagccgctccaatcagc

SEQ ID NO: 23296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcggtcgagagggttgtgggtcttgcgt

SEQ ID NO: 23297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcggtgaggaaagggtgcaagggggacc

SEQ ID NO: 23298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgtaatgatttaggggtacggatcgcg

SEQ ID NO: 23299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcgtcgggggaacgatgcttacttctct

SEQ ID NO: 23300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctaaggtccttactccgagacgtctac

SEQ ID NO: 23301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctacctaggttgtatgcataccgaggg

SEQ ID NO: 23302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctagcaggcgttattccgacttagcct

SEQ ID NO: 23303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctagtgctgcaaatttggtaggaggac

SEQ ID NO: 23304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctatccttggtggcgaacttttaaccg

SEQ ID NO: 23305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctcgaggattgatcgggataagggggg

SEQ ID NO: 23306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctcttaatgcgggttcgccaagcgggt

SEQ ID NO: 23307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctgcgatagtggtgttatgcgtacgaa

SEQ ID NO: 23308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctgctagtcctatgtcaattggtcgga

SEQ ID NO: 23309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctgctgtcatggttgacccgttatgcc

SEQ ID NO: 23310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctggaaaggatcataccgcctaaactc

SEQ ID NO: 23311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctgtgctacgagtgggttgtggtgtcc

SEQ ID NO: 23312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggctgttcctccccgcgagtggctgtggc

SEQ ID NO: 23313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcttccgatgacctcaacacgtcctcca

SEQ ID NO: 23314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcttgatttactttagccgtttctccta

SEQ ID NO: 23315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcttgcatgtagagcgatgtcacgggag

SEQ ID NO: 23316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggcttggtgataccgggtacgttcaatgg

SEQ ID NO: 23317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggaaaaccgcatagagatcctatttgcc

SEQ ID NO: 23318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggaaggtattaacgtttctcgacattca

SEQ ID NO: 23319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggaccagaaggggacaaatagagttcac

SEQ ID NO: 23320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggacggctgtcagttggatgtggttaag

SEQ ID NO: 23321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggagggatcacgagcgcttaggattttc

SEQ ID NO: 23322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggaggtttcctcgccaagttccagccct

SEQ ID NO: 23323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggagtgctacacgtgcactgggcagggg

SEQ ID NO: 23324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggagtgttcaagtcttgaaccattcgtt

SEQ ID NO: 23325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggatagttgtcgtgacgtttcgtggggt

SEQ ID NO: 23326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggatggacaagttaggttttgtgatgct

SEQ ID NO: 23327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggatgggacacgtggcggacatgcgtat

SEQ ID NO: 23328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggattagggcaaagtttgaggtggggtg

SEQ ID NO: 23329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggattgagtgcgtggggacgtgtccggg

SEQ ID NO: 23330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcaagattgtggaccgtcgttgttacg

SEQ ID NO: 23331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcaagtcggacaagggcggtaccgacg

SEQ ID NO: 23332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcacgaaagtgtgcagttttcttccgc

SEQ ID NO: 23333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcacggcgggtcgttcacttttttgtc

SEQ ID NO: 23334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcagtgacggggcttcctcgcttgggt

SEQ ID NO: 23335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggccactatggcgcgctacatcccacgc

SEQ ID NO: 23336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcccgtaagtgataggtattatgtggc

SEQ ID NO: 23337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggccggcactctcgttcccgtttggaat

SEQ ID NO: 23338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggccttgcgctgcagttctaagcatgac

SEQ ID NO: 23339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcgacaatcatcgtacaggggcggcgg

SEQ ID NO: 23340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcgacacccattgtttcacttctcaca

SEQ ID NO: 23341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcgacggtctgggttgttggagcgtat

SEQ ID NO: 23342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcgctccctcatacgtagtggctagtc

SEQ ID NO: 23343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggctccggagaacgtatcgtgatgcccg

SEQ ID NO: 23344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggctgtagaaaaggtgtcttgctcgtca

SEQ ID NO: 23345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggcttgggcagcagacgcacagtgaata

SEQ ID NO: 23346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggaagatcccactctcaaacgggagtg

SEQ ID NO: 23347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggaggccgctattcgccgtatgctcgg

SEQ ID NO: 23348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggaggttggacaaagtgatggtcgcgt

SEQ ID NO: 23349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggatgggagttgggcagaaaacggcac

SEQ ID NO: 23350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggcacgtacccgccttgcaccactgcg

SEQ ID NO: 23351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggcgtgtcggtattatcatggtgcacg

SEQ ID NO: 23352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggggaggtgctagcggtgacttagctga

SEQ ID NO: 23353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggggttgtttccgattcttgactggtgg

SEQ ID NO: 23354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggtctgcgggatttgcttcacttggcg

SEQ ID NO: 23355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggtgcgcatgactactagacagggacg

SEQ ID NO: 23356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggtggggatggctaaatggacctttgg

SEQ ID NO: 23357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggggtggtactttgaccgttgtatagggg

SEQ ID NO: 23358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtaactcgggatacatgtctagatcgc

SEQ ID NO: 23359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtacgggaatctttcatcgaatgtgcg

SEQ ID NO: 23360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtatatcccctttgattggggtaccta

SEQ ID NO: 23361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtcggggctgtgctcttctcggggtaa

SEQ ID NO: 23362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtgacgagtgtttgtcatatccaacac

SEQ ID NO: 23363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtgccatgccagttgtccgccgtagac

SEQ ID NO: 23364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtggtttggagtttcggtggggtaaga

SEQ ID NO: 23365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttacactttctgcttcgcgttcgctt

SEQ ID NO: 23366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttacccttggatacgtccgagctcct

SEQ ID NO: 23367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttagtcaagtagtacgatagttagtg

SEQ ID NO: 23368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttcctttcaatctcaccgcatgagag

SEQ ID NO: 23369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttcttatgttagagtaccaatcgtcg

SEQ ID NO: 23370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttgaggatgcctgcgtaccggtgcgc

SEQ ID NO: 23371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttgcagcgatgtggcctctcgcggtt

SEQ ID NO: 23372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttggcgatgccgtctagttaaggtgt

SEQ ID NO: 23373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttggtgtcgcaaggcttgtgaattcc

SEQ ID NO: 23374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttgtgaagtcgtgacagattgtgccc

SEQ ID NO: 23375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggtttaccgcatcgacgtatcttaccac

SEQ ID NO: 23376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggggttttttgtcaataccgtttacgtaag

SEQ ID NO: 23377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtaatagtacagtggcccgcctcgacgc

SEQ ID NO: 23378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtacagtaaaccatggggtgatatggcg

SEQ ID NO: 23379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtacccatcagacatctccaacctttga

SEQ ID NO: 23380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtacgcgccgatacgtggctgtttagcg

SEQ ID NO: 23381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtactggtagtagcaagtcctttcatgc

SEQ ID NO: 23382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtagggtccaaggcttctttatacgtgt

SEQ ID NO: 23383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtaggtccccttccgtcgttcatgtggt

SEQ ID NO: 23384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtagtctggtgcttgcgctggggccgcg

SEQ ID NO: 23385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtatgcgcatgtttactacgacgttgac

SEQ ID NO: 23386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtatggaggatcacttcccccggttaat

SEQ ID NO: 23387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcaaccgctcgctgtaatgcgtggccg

SEQ ID NO: 23388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcacatggtcagataccggggatttgg

SEQ ID NO: 23389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcaggcgttttgcactcggtggctggc

SEQ ID NO: 23390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcatcgaagggctcggacacctccatc

SEQ ID NO: 23391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcatgcgggtagcccgctgcaattaca

SEQ ID NO: 23392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtccgcagaatctcccttcgctcaatcg

SEQ ID NO: 23393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcctgcaaacagcgaaaagtgagggga

SEQ ID NO: 23394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcctttccgggagggcaaatgtcttgt

SEQ ID NO: 23395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtcgctacttccaggagaaaaagtttta

SEQ ID NO: 23396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtctaatgctattccgggatagcctcta

SEQ ID NO: 23397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtctaccttgaagtcttcccctcgttca

SEQ ID NO: 23398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtctgggtcgtcatggatctaagccggg

SEQ ID NO: 23399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgaatggagcgagaagctgaccctacg

SEQ ID NO: 23400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgacacggggagcattctatttttggt

SEQ ID NO: 23401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgcgaaaagcaggactggacagggttc

SEQ ID NO: 23402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtggacgctgcattaagatccttgctcg

SEQ ID NO: 23403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtggagtagccagacggttttcttaagg

SEQ ID NO: 23404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtggcatcccttcgaccatggtgcattc

SEQ ID NO: 23405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgggagaagacagacgcccgatttggc

SEQ ID NO: 23406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgggtgctcaagaggcgagttggtcgc

SEQ ID NO: 23407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtggtccgttgatgctgttccctgcgga

SEQ ID NO: 23408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtggtggtgggagagtagggattgagcg

SEQ ID NO: 23409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgtacaatctggtcggtttttgatgtt

SEQ ID NO: 23410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgtcgtggtgtagccaattgtggtgac

SEQ ID NO: 23411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtgtgcgggtattgatcgctccgtcggt

SEQ ID NO: 23412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttcagcacgggtgctggtcgacattct

SEQ ID NO: 23413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttccacttttgattgcgagcggctaac

SEQ ID NO: 23414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttcgcggcgcccttgtacagtacgcgt

SEQ ID NO: 23415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttgaactcgtcggtgtctggtgtgatt

SEQ ID NO: 23416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttgctagacatactttgaccgctggtt

SEQ ID NO: 23417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttgctctctcgtctctgttcaatgtgc

SEQ ID NO: 23418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttggagtcgcgaggtcattccttgtcg

SEQ ID NO: 23419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttgggctgttgccacggtatcaagcgg

SEQ ID NO: 23420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtttcactgggttctgcgctgtcctcgt

SEQ ID NO: 23421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggtttgtcgatgggtgtgggcttcgtaaa

SEQ ID NO: 23422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgggttttggtcggatgacggcgagatctgg

SEQ ID NO: 23423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaaacggcctgactcacggataatgcca

SEQ ID NO: 23424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaaccccccctgtttcgatacctcccca

SEQ ID NO: 23425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaacgcaacgaggctgtgctggcgcgaa

SEQ ID NO: 23426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaacgggacttagatagagttgcacatg

SEQ ID NO: 23427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaacgggaggcattccgcgcttcgatcg

SEQ ID NO: 23428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaaggggtgccaatcaaacctgctttac

SEQ ID NO: 23429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaattcaggttaatcagtgaggtttgta

SEQ ID NO: 23430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaccagtagctcgaggattaacaggtca

SEQ ID NO: 23431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtacgatgggggaggagcgctatatgggc

SEQ ID NO: 23432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtacgcgctgacaatgcatcggggtccgt

SEQ ID NO: 23433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtacgcggttcagggatattgtggtctgt

SEQ ID NO: 23434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtactgtactgctgcaagggtgtctcttc

SEQ ID NO: 23435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagactgtcagcgcacgagacgtagttg

SEQ ID NO: 23436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcagtaggcaatacatgctgcacata

SEQ ID NO: 23437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcatacgactgtcgcctccggttacg

SEQ ID NO: 23438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagccatactcttcggtctcgcggctac

SEQ ID NO: 23439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcgacttgcttctagcggtgatcggc

SEQ ID NO: 23440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcgcggggtaggtttggctaaggtcg

SEQ ID NO: 23441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcggagcgtcctggtgtgctggtagc

SEQ ID NO: 23442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagcgttgattcttgcctctcgctatca

SEQ ID NO: 23443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtaggatgtgtctcggtgcgtcagctaag

SEQ ID NO: 23444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagggttctagcgcattagctgggtacc

SEQ ID NO: 23445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagtgaactgtgggttgtagctcaatct

SEQ ID NO: 23446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtagtgtgtggggaaatcagtagggtgcg

SEQ ID NO: 23447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtataatagcaacttcggctgtctgctgt

SEQ ID NO: 23448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtatagaccttgcatggcagcctctccaa

SEQ ID NO: 23449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtatcgcaaaacaccattacatgctttcg

SEQ ID NO: 23450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtatgggttcaagtgaacgtcagcatttt

SEQ ID NO: 23451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtattagggctccctgcggattgggcgtg

SEQ ID NO: 23452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtattcgaggcctgtgttcaaaagtcttg

SEQ ID NO: 23453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtattgggggtgtgatctgagttcgtgca

SEQ ID NO: 23454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtattgtcgccacatttgccgggagtccg

SEQ ID NO: 23455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtattgtgtttattgagtgctgtagtagg

SEQ ID NO: 23456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcaaacaagaaggcagttgcgtaggccg

SEQ ID NO: 23457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcacagctcccaatgcaccagggttgcc

SEQ ID NO: 23458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcacgtcattccgaagatagtgttccgc

SEQ ID NO: 23459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcactggataggttcgaccaccccgaca

SEQ ID NO: 23460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcagttacaaaagttctgtatgcttaac

SEQ ID NO: 23461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcatcacggactcaactcgttcgcaggt

SEQ ID NO: 23462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccacatttaggatcgtggtattgcctc

SEQ ID NO: 23463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccagtattgactcggcgctcccccggc

SEQ ID NO: 23464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccattacgctgtaacctgctatcgcta

SEQ ID NO: 23465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcccaaatcccagatcgcagcagaggac

SEQ ID NO: 23466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcccacccaatgtcgttgttaggcggct

SEQ ID NO: 23467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccccgcttggaactaccgcttggtggt

SEQ ID NO: 23468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcccgggctaggcctgcgaatacgggac

SEQ ID NO: 23469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcccgtaggaggctttcgctctttgtca

SEQ ID NO: 23470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccgcaatttcaaggcggcgctagtttt

SEQ ID NO: 23471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccgccgttcagatcatatattccctag

SEQ ID NO: 23472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccggcgaaacttagatggcgcagttgt

SEQ ID NO: 23473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccgtttctttaactcgctattccgcta

SEQ ID NO: 23474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcctagattcacacatacagctgcgctt

SEQ ID NO: 23475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcctcactgtaacgccgtatcatactag

SEQ ID NO: 23476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcctgagtacgggatacagcgacaccta

SEQ ID NO: 23477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccttggctttaatgctggttagtgccg

SEQ ID NO: 23478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtccttgtatgccgatgcttctccaagca

SEQ ID NO: 23479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgaatacctcggctggtgcttcttgga

SEQ ID NO: 23480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgacacgaggttatctgtatgcgcacc

SEQ ID NO: 23481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgagtaaagctcggagactaaacgtcg

SEQ ID NO: 23482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgatcggacatttcacgttccggtaat

SEQ ID NO: 23483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgcaacacaacccttcttctcgggctt

SEQ ID NO: 23484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgcagcttgaggcaaattatggctctc

SEQ ID NO: 23485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgccacacgttgtatcggatctttccg

SEQ ID NO: 23486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgctagcgggtcctaaccgttctgagc

SEQ ID NO: 23487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcggaggggatacgaccctgtgcagagg

SEQ ID NO: 23488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcggagtcgtcggtcatcgttggtagtg

SEQ ID NO: 23489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcggggctaaggcgtatacccgcaagac

SEQ ID NO: 23490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgggtgaaagccatgtcttgcgcgtat

SEQ ID NO: 23491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgtgggagcgcttattcgtttagcgtc

SEQ ID NO: 23492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcgtgtagaggcctacatcccgtttgaa

SEQ ID NO: 23493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctaacttctcggaacctgcacccgtcg

SEQ ID NO: 23494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctacgtccaaacagttttgcttgcagt

SEQ ID NO: 23495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctatagctctctactgatccggtggtc

SEQ ID NO: 23496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctcatacagatgacaagggcgtagtat

SEQ ID NO: 23497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctcgcagttccggttgttttcttggtc

SEQ ID NO: 23498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctgcgtgtaccggtgtcatggtgggca

SEQ ID NO: 23499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctggccgcggttttgtacccccgctgc

SEQ ID NO: 23500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtctggctcctggaaccccgaccttaact

SEQ ID NO: 23501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcttacgtttagcctaaccgcctggcgt

SEQ ID NO: 23502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtcttcaagtgtggatttgtttcagtatc

SEQ ID NO: 23503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgaagagacatcaatgtatcgagaccct

SEQ ID NO: 23504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgacgagttggtttaggtgctgaggata

SEQ ID NO: 23505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgactgtcacggttggagttaaccaatg

SEQ ID NO: 23506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgagcagcggaccatctcaaggtgggcg

SEQ ID NO: 23507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatagccagtcaatctgttacggatag

SEQ ID NO: 23508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatatattttcgcatcctacattctag

SEQ ID NO: 23509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatcaaagtgttccagagaaagcgaat

SEQ ID NO: 23510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatcaagaagatcagcttccatgacgt

SEQ ID NO: 23511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatccttagcgcccgctctcttcgctt

SEQ ID NO: 23512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatgccaaaggtgcaatccacgtctag

SEQ ID NO: 23513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgatgcccacggttggtctggcagtagc

SEQ ID NO: 23514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcaatcggtggggaattcagtccaaac

SEQ ID NO: 23515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcaccgctacctcgcgagtcctggtgg

SEQ ID NO: 23516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcacgccgaacgtcgggcgccaggggg

SEQ ID NO: 23517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgccaatttgaccctcgcaccaagtttg

SEQ ID NO: 23518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgccgcacaggcaacatccacggcattg

SEQ ID NO: 23519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgccggttgagccatgtgccgtacggtg

SEQ ID NO: 23520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcgagaccaggatggttactccgaatc

SEQ ID NO: 23521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcggatcgttcttcttcgcgatggagc

SEQ ID NO: 23522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcggcgagtgaacactagcgccctcgg

SEQ ID NO: 23523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcgtactgatgtttcatagcaaatcgc

SEQ ID NO: 23524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcgtgtgcggcgaagatgtactggtgc

SEQ ID NO: 23525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgctgcatggtggtaagctcaagtgtgg

SEQ ID NO: 23526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgctgctgtccaagcgaaggcgcttggg

SEQ ID NO: 23527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgcttttctgatttgagttggacgctcc

SEQ ID NO: 23528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggacccaagattgacgcgaactttggg

SEQ ID NO: 23529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggatcttcgaagcgtctagaccgttgt

SEQ ID NO: 23530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggcaaatgctggtcggtcctcgcatgg

SEQ ID NO: 23531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggcaacgtgtacctcatggctggcgtc

SEQ ID NO: 23532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggcgattagctgcgtaaggtttacgat

SEQ ID NO: 23533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggcggcgttaatggattacgtgcgttc

SEQ ID NO: 23534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgggagagctgtgctgggagacagctcg

SEQ ID NO: 23535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgggatctttcttttagagtggaaaccc

SEQ ID NO: 23536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggggtcgcggctgtggctacgacaaat

SEQ ID NO: 23537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggtaaacatgcggattgggggatctat

SEQ ID NO: 23538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtggtggctgcagcggctttggttctaga

SEQ ID NO: 23539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtagatctgttctggtattctccgttg

SEQ ID NO: 23540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtatacccaggttgccgctcgtgaatt

SEQ ID NO: 23541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtatcatgcgtattagccgctctctgt

SEQ ID NO: 23542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtcttggtagagtggcacaccacggat

SEQ ID NO: 23543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtgtcaacgagcgcaggacccgtgcga

SEQ ID NO: 23544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtgtgcagcttccagagtctagtcgca

SEQ ID NO: 23545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgttccggaggcatcgtgacagctataa

SEQ ID NO: 23546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgttcgttcctcttagtgacctatgggc

SEQ ID NO: 23547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtgtttcgtggcgttgacaagcggggagt

SEQ ID NO: 23548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttaatgtcggaggctcgcatttaatatg

SEQ ID NO: 23549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttaattacacgtatgctaattgaggggt

SEQ ID NO: 23550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttactcgttgaaccccacaatcggtcgg

SEQ ID NO: 23551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttactgtaggctgggttgtaggaactgg

SEQ ID NO: 23552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttagcatgcgctgttaaagaacggagtg

SEQ ID NO: 23553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttagcccattagatatacttgatttacc

SEQ ID NO: 23554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttatccggggtctggctgcctattagag

SEQ ID NO: 23555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcagcaggaatgtgcagaccctcgtga

SEQ ID NO: 23556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcattacacactcatgctgaattcgcg

SEQ ID NO: 23557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcccataggttccttcaggtaatagcg

SEQ ID NO: 23558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcctcctcgtatcgtggtccctactct

SEQ ID NO: 23559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcctttagcactttttagtagggcaga

SEQ ID NO: 23560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcgacccttctgtaacggtatagttga

SEQ ID NO: 23561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcgagtatgcagccagtcaagggtccg

SEQ ID NO: 23562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcgctagtcctttttgtgtcaatggcc

SEQ ID NO: 23563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttcgtcgcgcttgggtctggagaaactt

SEQ ID NO: 23564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttctaaattacactttcggattatttgt

SEQ ID NO: 23565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgaactcggcgtacactcaaactggcg

SEQ ID NO: 23566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgaagttaaatgccctactgtaggtgc

SEQ ID NO: 23567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgacgctaagtggcgactttcattgcg

SEQ ID NO: 23568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgagggagattcattggtaaaagtttc

SEQ ID NO: 23569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgcagcttccaggcatattgatccgcg

SEQ ID NO: 23570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgcatttgcaatttacggttatgatat

SEQ ID NO: 23571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgcgctccagaggtgtgaccaacgcat

SEQ ID NO: 23572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttggaaggccctccgtgttggatgcctc

SEQ ID NO: 23573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttggagtaacgagtccacagtatgacgg

SEQ ID NO: 23574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttggcgacaggacacggatacctcattt

SEQ ID NO: 23575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttggctttagcaactatggagggtggac

SEQ ID NO: 23576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttggtcatgccggaaagcccggtatccg

SEQ ID NO: 23577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgtactactgtgtaagggtattaccga

SEQ ID NO: 23578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttgtgcgttcatgacttctcgctccttg

SEQ ID NO: 23579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttcaaggtcttcctcgactgacggcgt

SEQ ID NO: 23580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttcatgattgccaatcttgtatttgcc

SEQ ID NO: 23581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttcattaggataggtgtagcctggttg

SEQ ID NO: 23582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttccgtcgaagagtgcgcatcatatta

SEQ ID NO: 23583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttcgggagtatattgaggtcagcgagg

SEQ ID NO: 23584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttctggcaacctcgcacggcggatgtt

SEQ ID NO: 23585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttgctggtcctacgctggccctctaga

SEQ ID NO: 23586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggtttgttcacctacgttaataaacatgtt

SEQ ID NO: 23587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccggttttggttttgggagagcgcgctagtgt

SEQ ID NO: 23588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaaaaatcattaatgtcctgatttgggcg

SEQ ID NO: 23589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaacaattgaggcactcacggcgccaact

SEQ ID NO: 23590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaaccgttcttagacccggacgcaaatgc

SEQ ID NO: 23591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaacctgactcctggcgctttcgatctgt

SEQ ID NO: 23592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaacggatgtggacagggtagtatccgtc

SEQ ID NO: 23593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaacgtgcggctgtagctatccgttgtcc

SEQ ID NO: 23594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaacttatgttataggttggttgcctctg

SEQ ID NO: 23595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaagacaaagaatcgacaccgacaccggg

SEQ ID NO: 23596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaagcgtacaagagatgttcgggctgtcg

SEQ ID NO: 23597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaatattctgtgcctcttctggttagggt

SEQ ID NO: 23598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaatgcagttgacattattactccctccc

SEQ ID NO: 23599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaatggactcacgaccgggctagtaccgc

SEQ ID NO: 23600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaattaccgtacctctgtatcatgtgtaa

SEQ ID NO: 23601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaatttattgacagtgggctcactggtga

SEQ ID NO: 23602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacaatcgttcttttgtgcaggagtatcg

SEQ ID NO: 23603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacaatgacttgtctcaccagaggacgtg

SEQ ID NO: 23604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacacagggattcacaagttgtgtctcgc

SEQ ID NO: 23605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacacccgaattaagaccctcatttatgc

SEQ ID NO: 23606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacacccgtgttttaactttgttccgtgg

SEQ ID NO: 23607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacaccctgccccaaacttaaccttttat

SEQ ID NO: 23608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacactgatattgtgagcgtatcgctaga

SEQ ID NO: 23609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacagatcgcgcatcgccattttatccca

SEQ ID NO: 23610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacagccctgcattgccctcttgctcttt

SEQ ID NO: 23611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacaggttggatcgaggaactaggtatgg

SEQ ID NO: 23612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacatatggcaattgcgttccgatcccgt

SEQ ID NO: 23613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacatggtggcaataccctcattcgctcg

SEQ ID NO: 23614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaccacgccactgacagagtttgctcagt

SEQ ID NO: 23615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaccagcggtacgagatcaaggggttttt

SEQ ID NO: 23616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaccatgcggaggtggcattctcacgcgg

SEQ ID NO: 23617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacccgttcacaacacgtgtttgacactc

SEQ ID NO: 23618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaccgaggttacacatgggcgtagatcgg

SEQ ID NO: 23619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaccgtcgatccaccgcccacgcatggct

SEQ ID NO: 23620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacctaccgcgaacggaggcgacccatgg

SEQ ID NO: 23621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgaccgtcatgtatcccggctcgttct

SEQ ID NO: 23622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgagtatgctgccacatgcccgccttg

SEQ ID NO: 23623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgataacgcgcgaggtcatgcggtcca

SEQ ID NO: 23624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgcgcacatgaacgtatgaccttcgcg

SEQ ID NO: 23625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgctaatttcgccgataagtcagcatc

SEQ ID NO: 23626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacggagcgagtggctctagtatcttgtc

SEQ ID NO: 23627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacggtcacgagagcgagcgcgtgccgcg

SEQ ID NO: 23628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacggttggtccggtaagaaacatccatg

SEQ ID NO: 23629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgtgcacgcgaagtgaacagactgacg

SEQ ID NO: 23630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgtgtcctcaacaggccgaaggcacgt

SEQ ID NO: 23631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtacgttgtcatggcttggtagccgctcgc

SEQ ID NO: 23632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactaaaccgctgatctgaacacagtctg

SEQ ID NO: 23633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactaaggacatcggcggctattggtccc

SEQ ID NO: 23634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactagtccacccgtgcgattgggatcgc

SEQ ID NO: 23635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactcagtttccggtccgaatgctccatt

SEQ ID NO: 23636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactcgggtgttgccctgtttttgagggg

SEQ ID NO: 23637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactgatctggcccgtgcgaagacaccac

SEQ ID NO: 23638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtactgcaatgtttcgagcaaatctttatt

SEQ ID NO: 23639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagaatattggaggtacggagatcaccat

SEQ ID NO: 23640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagaatctgtcgtgtctgggattgtgcgt

SEQ ID NO: 23641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagaatgccgcgcgtgggtgtaggcagcg

SEQ ID NO: 23642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagacaagagattgctgcaggcgtcgaac

SEQ ID NO: 23643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagacaggtaaccggttcgcgatcaactc

SEQ ID NO: 23644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagactttcacgctcccgctcataccata

SEQ ID NO: 23645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagaggaaatctatcgcgatgggatcacc

SEQ ID NO: 23646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagaggtcgcgcgtaactgcggctggcgg

SEQ ID NO: 23647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagataattgctcaaacctttactgtagc

SEQ ID NO: 23648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagatgtccgggtgaaagacatcatccga

SEQ ID NO: 23649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcacgttgagctaccgtctctctgact

SEQ ID NO: 23650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcagcgcggaaacttctgcatacttta

SEQ ID NO: 23651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcaggttgtgttatgtcaccgtccaga

SEQ ID NO: 23652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcatggtgtcacgtcttggtttcggaa

SEQ ID NO: 23653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcccaggctaataccttcttactacgc

SEQ ID NO: 23654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcgctatgtgtcatttccatcctgcga

SEQ ID NO: 23655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcggagtactctgattcgctgtcgttt

SEQ ID NO: 23656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcggcaaggtttcatgaccgaggttcc

SEQ ID NO: 23657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcgggcagacggtgaggcagccgtgac

SEQ ID NO: 23658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcggtcgtaacagttgggacaggttag

SEQ ID NO: 23659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcgtcctcttatgtcatgagtcacggg

SEQ ID NO: 23660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagcgtcggctcctacctcgatggcttat

SEQ ID NO: 23661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagctgctggtacagtgagggcgtgcagt

SEQ ID NO: 23662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaggacagaaaagctgaccgggggagctg

SEQ ID NO: 23663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaggatgccggcaacctgcgaacaaggat

SEQ ID NO: 23664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagggtatgctaagctatgttgggcgcgg

SEQ ID NO: 23665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaggtcggtgcatatgttgtaaatggggg

SEQ ID NO: 23666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaggtgagcgatgggccctcatggtacgc

SEQ ID NO: 23667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtaggtgtcgtttttgattcagcaaagcgt

SEQ ID NO: 23668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagtcaccatgtcacctggcttgaatatg

SEQ ID NO: 23669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagtcatcggggggaatgggcgtaggttt

SEQ ID NO: 23670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagtggatgatttggcgaacaggaagccc

SEQ ID NO: 23671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagttcacgcaattacccgcgcccccaac

SEQ ID NO: 23672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtagttcggtgcctcgttcagaaatcggga

SEQ ID NO: 23673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatacagttccattaattccgtcttgcgg

SEQ ID NO: 23674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtataggacaaggttccttttggtgctcgc

SEQ ID NO: 23675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtataggagaagaatgcggtgagacctgca

SEQ ID NO: 23676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatagtctgtaaaggtcagcatgtgtcgg

SEQ ID NO: 23677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatagttagctagcgaccggtaaagcggg

SEQ ID NO: 23678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcaatctcggttccgcgaatgacccgg

SEQ ID NO: 23679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcaattctgtggatataaagccctcgg

SEQ ID NO: 23680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcccgatcgtaaccccggttcggagca

SEQ ID NO: 23681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatccttgtcggttttttattagctctcc

SEQ ID NO: 23682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcgagaatcgcaacggccgtgtcgatg

SEQ ID NO: 23683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcgtctcgcttactcgcatctctcgtt

SEQ ID NO: 23684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatcgtgggcctttccatcagctccgagt

SEQ ID NO: 23685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatctgtaactgccgttcagggacatgcc

SEQ ID NO: 23686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgcaacgcaaactccgaggaaagaaac

SEQ ID NO: 23687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgccgagacctcgcgggttggtcatgt

SEQ ID NO: 23688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgccggtgtggactgcagctgtggtta

SEQ ID NO: 23689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgcgtgacttatagttgtgggttactc

SEQ ID NO: 23690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgggaaagggcaagagaacagtggccc

SEQ ID NO: 23691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgggaagagtgagcttcgatgcatgtt

SEQ ID NO: 23692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgtgggccgtgcggtaggggatgcagt

SEQ ID NO: 23693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatgtttccattaggcaagcatttcgact

SEQ ID NO: 23694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtattgtgccatggtcagctacccgaggtt

SEQ ID NO: 23695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatttcttccgtctttgttacaaggggag

SEQ ID NO: 23696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtatttgtacggaagccatcgaatgtgttc

SEQ ID NO: 23697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtattttaggagagagaattttttgccccc

SEQ ID NO: 23698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaaagccgaggtttcatacttcccggtt

SEQ ID NO: 23699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaaatcagcttgggttccgactctctat

SEQ ID NO: 23700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaacagagtccgctacgatagctcttag

SEQ ID NO: 23701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaacgcaactccgttttaaaggatgggt

SEQ ID NO: 23702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaacgtgacgtgagtctaggacgggccg

SEQ ID NO: 23703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaagatgctctagaatgaatggggttcg

SEQ ID NO: 23704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaagcgttcggttgggtggtagcgctgg

SEQ ID NO: 23705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaagggaaaaaagtatcgaactgcatgg

SEQ ID NO: 23706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaatcacggaatcgcgtggatatacggg

SEQ ID NO: 23707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaattagcggcgcggtctaagttgagga

SEQ ID NO: 23708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaattcagtttctctgcattacacccgt

SEQ ID NO: 23709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcacagccaacattgactagctcgaacac

SEQ ID NO: 23710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaccactccgaaatgtagagtagcctgg

SEQ ID NO: 23711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcacctataaccaggtgtacaggcggctg

SEQ ID NO: 23712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaccttgagtacagcttcaggcagtggt

SEQ ID NO: 23713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcacgatagcacgtatccgcacggcgccg

SEQ ID NO: 23714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcacgccatagctagtgtagatatcggcg

SEQ ID NO: 23715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcactcaatctccgatcaggctcaacgcc

SEQ ID NO: 23716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcactcccgtcgtagtcaacgattcacca

SEQ ID NO: 23717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcagatgtctgtcatgcctgaagactctg

SEQ ID NO: 23718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcagcagacgtgggcacgccgagcttgat

SEQ ID NO: 23719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcagcaggggcgcatgtacaagtatgggc

SEQ ID NO: 23720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcagcgtgtagcggagggtagcactcgcg

SEQ ID NO: 23721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcaggagcaatcacgatgcccgactgcgc

SEQ ID NO: 23722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcagttgatagcggcagcgtggcatcatc

SEQ ID NO: 23723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcataagcaatgcagtgatactcgagacc

SEQ ID NO: 23724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcatacgacacaaggccgtcccgtatgtt

SEQ ID NO: 23725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcatcggaacacgtctgtgagcttggttg

SEQ ID NO: 23726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcatgccgcatagtcaccgttttcacaag

SEQ ID NO: 23727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccaactccctcggaccaacgtttttgcc

SEQ ID NO: 23728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccaactgactgtcacccggcgtcgtttt

SEQ ID NO: 23729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccaccccggagatcacgcccgtctggtt

SEQ ID NO: 23730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccactgtaatggtgggaaagtgggacaa

SEQ ID NO: 23731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccagatgtctcgatagattaacttcccg

SEQ ID NO: 23732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccagcgggcaggtcgtactaggacgtca

SEQ ID NO: 23733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccagcgggtcctgccttaacgatatggg

SEQ ID NO: 23734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccagctgccctccttcactcatcaagtg

SEQ ID NO: 23735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccattaccaggttattgccggaccccga

SEQ ID NO: 23736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccaatctttgttagatggatagcatta

SEQ ID NO: 23737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccacctcgatctggctttcgagtggtt

SEQ ID NO: 23738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccagcggctttctgtggttaaatcggg

SEQ ID NO: 23739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccattgttgccaaatattaccccggcg

SEQ ID NO: 23740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccccaccgaaaatgtacatttgggtcg

SEQ ID NO: 23741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccccgtttctgcatgttgtgtccaggac

SEQ ID NO: 23742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccctttgcgtgcatgctgaacttggcg

SEQ ID NO: 23743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccgagtttagccatccgcaattgacgc

SEQ ID NO: 23744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcccgccagtgtataacctgtcgtcgcga

SEQ ID NO: 23745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccctaccccaggcgtcgggtctttgggc

SEQ ID NO: 23746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgaagcttgctagtaaaatgggcgaac

SEQ ID NO: 23747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgaaggcgtccacctgcgcagaaccat

SEQ ID NO: 23748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgacgaagtgccctgtgttacactccg

SEQ ID NO: 23749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgacggtatgcccaccgtgagcgcgcg

SEQ ID NO: 23750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgatcactgaaccgatggacaccccgg

SEQ ID NO: 23751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgattcaggtggctctacgtgtgctta

SEQ ID NO: 23752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgcataggtttcctgttctcccccgcg

SEQ ID NO: 23753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgccattgcttaggcatcccccccctg

SEQ ID NO: 23754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccggcgcgtagaggcgcttatgtgctgg

SEQ ID NO: 23755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccggtgctcgcttatcctgcgcgaggaa

SEQ ID NO: 23756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgtgtatactcggcccgatccggtcat

SEQ ID NO: 23757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgtgttccgcttaagccatcgccgagt

SEQ ID NO: 23758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccgtttctcccagctctccgctgcggta

SEQ ID NO: 23759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctaacgaccgtttttactgtcccaatc

SEQ ID NO: 23760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctacacgtcattgacaacggatcatgc

SEQ ID NO: 23761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctcccgggtatatcggtcgcttggcaa

SEQ ID NO: 23762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctgacgtggtgggctattgttgccctg

SEQ ID NO: 23763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctgccacaaagcatcactcattactac

SEQ ID NO: 23764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctgggcaggccacttttctccgtggac

SEQ ID NO: 23765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtccttccagtccattaggctcgtcagtca

SEQ ID NO: 23766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcctttaccgtcctgcaccgttagggttg

SEQ ID NO: 23767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgaacagatgggatgagtttgtacgtgg

SEQ ID NO: 23768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgaataggagcgggagcgcgctatggca

SEQ ID NO: 23769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgacgacactgggattggtcagagtgga

SEQ ID NO: 23770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgacgagatctgcgtcccagtctagcac

SEQ ID NO: 23771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgacgattttagcgcgctggaatggagc

SEQ ID NO: 23772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgagaatcaggtaacggatgttcacgga

SEQ ID NO: 23773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgagcatcgggattgtgtggtctaatac

SEQ ID NO: 23774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgcaacatgggcgtgaggcactggggcg

SEQ ID NO: 23775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgcacgccttgcatgcctgtttgctgct

SEQ ID NO: 23776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgcgataaaggctgggcatagacgcgga

SEQ ID NO: 23777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgcgatcatctatgcttcctactaccct

SEQ ID NO: 23778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgctagaggattggccaaacgcccattc

SEQ ID NO: 23779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgctgtggggaagcggggttaggggtgc

SEQ ID NO: 23780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcggaactgaagggagatgggtatgggta

SEQ ID NO: 23781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcggagcttgtagtcgaggcgtgaggggt

SEQ ID NO: 23782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgggagtgtatgacaacgttcacgggct

SEQ ID NO: 23783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgggccttcggaagtgtaaggggccgat

SEQ ID NO: 23784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcggttgagtcttaccttcccgtgttctc

SEQ ID NO: 23785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcggttgcatgggcttaagcataatacgc

SEQ ID NO: 23786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgtgctgcagagtcttgcttgtatgtcc

SEQ ID NO: 23787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgtgtggggtaacgcgcacatccagcct

SEQ ID NO: 23788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcgtgttggcttgctgagtgcgtaccgtg

SEQ ID NO: 23789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctaacactggttcgtcaccctccgagct

SEQ ID NO: 23790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctaactcgttcgtaaactttggtgcgtg

SEQ ID NO: 23791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctacatggtggcaagaacctgtcgcatg

SEQ ID NO: 23792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctaccgaaatgaaagtgacgccctgctc

SEQ ID NO: 23793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctagcatgcctctctaatgcagcggaga

SEQ ID NO: 23794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctattcaattaaagtacttgtgtttctg

SEQ ID NO: 23795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctcatatgctgaatgtcctacgatactt

SEQ ID NO: 23796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctcatggtttcgagctttttgacggatc

SEQ ID NO: 23797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctcattataagcccctttcatgcaactc

SEQ ID NO: 23798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctcgatgcgatacaactatggatgcgaa

SEQ ID NO: 23799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgagctaaccctgatgacgcaagtttc

SEQ ID NO: 23800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgcggtggtgggggtggctctggtttt

SEQ ID NO: 23801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgcgtatagtcatatgagcgtgtagcg

SEQ ID NO: 23802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctggagcggcaagatttctgggtttgcg

SEQ ID NO: 23803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgtacgtcaccgttggacataaccgcc

SEQ ID NO: 23804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgtgattaagacagggccagcgatgcg

SEQ ID NO: 23805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtctgtttttcgttggggtgcagtatcgaa

SEQ ID NO: 23806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcttgcaactgcatccttttgcgtctgcg

SEQ ID NO: 23807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcttggtgggagggagattgtaacttcga

SEQ ID NO: 23808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcttgtagaaggtccgaagagtaggactt

SEQ ID NO: 23809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtcttttccttgagagtctttgttagcctg

SEQ ID NO: 23810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaaaggcgatcccttggataacgaggca

SEQ ID NO: 23811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaacgcgaatcagggtgacgtttctcgg

SEQ ID NO: 23812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaacgtgcataacatccgatggggtttc

SEQ ID NO: 23813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaactctgctcgcattcacccgtactct

SEQ ID NO: 23814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaagggccaccgcagtcaatttcctggt

SEQ ID NO: 23815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaatccgggcacactcatctgaatagtg

SEQ ID NO: 23816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaattctacgcgcaagcccggggtaaca

SEQ ID NO: 23817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgacacgttcaatgccacgttgccgctct

SEQ ID NO: 23818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgacagtggtggacgcggaatgtttcccg

SEQ ID NO: 23819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaccctagttgcgcggcgccggcacagt

SEQ ID NO: 23820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgacggcaattcttgtgatcttagggctt

SEQ ID NO: 23821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgactatttcgcacaatcatagcatagta

SEQ ID NO: 23822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgacttttggtctaccccacccggcacat

SEQ ID NO: 23823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgagacttgttatagacgtatttcctttc

SEQ ID NO: 23824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgagctatagagcttggtttgccttgtga

SEQ ID NO: 23825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgagctccccatacctcatctctgggtct

SEQ ID NO: 23826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgagcttgttgcggggtcaagacctgtac

SEQ ID NO: 23827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaggagacagtgaagcacctgataaggc

SEQ ID NO: 23828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaggagtccacgttcaaagccgcatttg

SEQ ID NO: 23829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaggcgcattgcatatcgcagatcagcg

SEQ ID NO: 23830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgaggttggttgaactctccatttaaggc

SEQ ID NO: 23831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgagtagggtggatggccgcgtccgtgtc

SEQ ID NO: 23832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatacttcgcaccgatgccgcacttctc

SEQ ID NO: 23833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatattaagccccaaggagatatcggga

SEQ ID NO: 23834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatcctcagctgtacgtttcttgcagct

SEQ ID NO: 23835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatcggtatccacgtttagccctgttaa

SEQ ID NO: 23836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatgaaagcaacttccagctcatgatct

SEQ ID NO: 23837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatgattccggtgcacaagcctgtctgc

SEQ ID NO: 23838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatgggatttcggcatcggaatttcgct

SEQ ID NO: 23839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatggggaccgcgatagcaacttggtaa

SEQ ID NO: 23840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatggtaccccttaaagcacttgtgtaa

SEQ ID NO: 23841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgattaaccaactgggtagttgatggttg

SEQ ID NO: 23842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgattatacgtgctttgataaagacatca

SEQ ID NO: 23843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgatttccgttaggggcgtgtgggacaag

SEQ ID NO: 23844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcaaactccaaattctagacctggccga

SEQ ID NO: 23845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcaaagcgtagtctggacatatggaccg

SEQ ID NO: 23846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcaaaggttccacgcgattctcggactc

SEQ ID NO: 23847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcaacgaaaggacaacggatggagtttt

SEQ ID NO: 23848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcacctcccactcctttgttttcggcgg

SEQ ID NO: 23849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcactagtggcgaggaatggtaaccgtg

SEQ ID NO: 23850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcacttgtttctctatttctgattccgg

SEQ ID NO: 23851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcagctcaacagccatgttgggggacct

SEQ ID NO: 23852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcaggaggaaactctttgtccagtccac

SEQ ID NO: 23853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcagtggacgcctcgcatgtcgagtacg

SEQ ID NO: 23854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcagttccgcgtgcaatcgcgattcttc

SEQ ID NO: 23855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcattgacacaatagttagacagcgacc

SEQ ID NO: 23856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgccatcacgcagcaggtttctcggacca

SEQ ID NO: 23857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcccagggtattgctccgtagtatcggt

SEQ ID NO: 23858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgccccctccgttcggcttaccaacagtt

SEQ ID NO: 23859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgccccggaggctctgggtgttgggtccc

SEQ ID NO: 23860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcccgtttacgttgtgggattttgctcc

SEQ ID NO: 23861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgccgagcgtagtaggcaggtccccggtg

SEQ ID NO: 23862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgagcaacaagctgatacccgaacgcg

SEQ ID NO: 23863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcagcttcgttaaaggttttaagatt

SEQ ID NO: 23864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcagggatttggtaccggatcacacg

SEQ ID NO: 23865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcccacctccgcttctggggatatac

SEQ ID NO: 23866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcccgagggtaaccgtatcgttctgg

SEQ ID NO: 23867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcgcaagactttgaggggtttgttag

SEQ ID NO: 23868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgcgttgcaagtaacgcaattcgttgt

SEQ ID NO: 23869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgctactgccagattgtggcaatcgta

SEQ ID NO: 23870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgctaggtccgttatccgccgacccct

SEQ ID NO: 23871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgctcgtaacgaaacggcttttcaccc

SEQ ID NO: 23872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcggcgcaatatgtcggtagcaccagtg

SEQ ID NO: 23873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgggcgttgactttaccttgacgtggc

SEQ ID NO: 23874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcggtttggcggtaggatggtatgggcc

SEQ ID NO: 23875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgtctgggctgaaacgttggggaagga

SEQ ID NO: 23876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcgttcgtgaagcttatcatggacaggc

SEQ ID NO: 23877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctcccatacgttaatcgggtgcggcca

SEQ ID NO: 23878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctcccgtcaggcttcggtcttctgttg

SEQ ID NO: 23879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctccctgacttgggtagagtaacggta

SEQ ID NO: 23880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctccgctgtatgggtcgaagttccccg

SEQ ID NO: 23881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctctttcggtcaggtatgcgctggaaa

SEQ ID NO: 23882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctgcgtatatcccttcggcacctgctt

SEQ ID NO: 23883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctgggaagatctgaaatgtagctgggt

SEQ ID NO: 23884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctgtgcaacaattgcccatactggtcg

SEQ ID NO: 23885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcttcagcatggtgaatatagcgttgtt

SEQ ID NO: 23886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcttcctcgtactttcacgtttcggata

SEQ ID NO: 23887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcttgtatcttctcacgctatttggact

SEQ ID NO: 23888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgctttcatcgtgctgcttatgctatggc

SEQ ID NO: 23889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcttttatctaagagtgcctgagaagtt

SEQ ID NO: 23890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgcttttggagaagtctggcaggagtgac

SEQ ID NO: 23891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggaacgccaactttacagtttcggtcgt

SEQ ID NO: 23892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggaagcacgcattcttgctggacaacgc

SEQ ID NO: 23893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggaaggtgggtatacaggattgactggc

SEQ ID NO: 23894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggacgatggaagagaaaggcataggttt

SEQ ID NO: 23895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggactactttgccctcaggggtgatgcc

SEQ ID NO: 23896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggagaagtttcagacccctgatgtgatg

SEQ ID NO: 23897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggaggaaccgtctcgttcgtcaccttag

SEQ ID NO: 23898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggaggcacgcgttgggcattctggatgt

SEQ ID NO: 23899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggagtagagtcgaatggacctcacacat

SEQ ID NO: 23900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggagtcggtaaggggaactcggactcgt

SEQ ID NO: 23901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggataatccatgtatctcgtcaattgga

SEQ ID NO: 23902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggattcaccttagccaggagtcaccggt

SEQ ID NO: 23903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggatttgccccaggctgcccatcacttt

SEQ ID NO: 23904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggatttgcggtgctcacagttcgtagcg

SEQ ID NO: 23905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcaacatcatcgcgccgagaagctggg

SEQ ID NO: 23906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcaaccgaaatccatgggggggctggt

SEQ ID NO: 23907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcagcgtcgttcgtatacgggccgggg

SEQ ID NO: 23908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcagctcggagttccaacaagcggcga

SEQ ID NO: 23909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcatgcttcaatactgtaatcaagggc

SEQ ID NO: 23910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcattacgggttggaagcatgttcgtc

SEQ ID NO: 23911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcattggggatcgcagatcatcgaaag

SEQ ID NO: 23912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggccagatgacaaagccccttcgttccg

SEQ ID NO: 23913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggccgagctcttcacgcctccaccgcca

SEQ ID NO: 23914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcgacgttcgagtgcctgatggcgctg

SEQ ID NO: 23915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcgaggggtgtggggggcgacaattac

SEQ ID NO: 23916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcgagggtcctggtacctagctgcgtg

SEQ ID NO: 23917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcgttgtagaattgcgtgtgatgcgga

SEQ ID NO: 23918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggctagaattggtcagtctatcatcttg

SEQ ID NO: 23919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggctcagggatctgcttggatgcacagt

SEQ ID NO: 23920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggctcatacggagcagtcggggtacgtc

SEQ ID NO: 23921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggcttgaggactgcattggtgcgatatt

SEQ ID NO: 23922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggaatgctcgttatcgcactaccacat

SEQ ID NO: 23923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggagctcgtcaatctgacctcttgtgt

SEQ ID NO: 23924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggatccttagtaaagcatccgctcaaa

SEQ ID NO: 23925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggcaatctgccgaggaaacatgttgtc

SEQ ID NO: 23926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggcaatggttcggtgtaacatccgtac

SEQ ID NO: 23927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggcacccgacgtatcacagtgggaacg

SEQ ID NO: 23928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggccaaggtccgttttacgtggttcgt

SEQ ID NO: 23929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggggcttttggttagcagcgctggtcgg

SEQ ID NO: 23930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggggtgaactgttggcgatcgcgtgccg

SEQ ID NO: 23931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggtaatcctgcctcttgtgttattggc

SEQ ID NO: 23932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggtgtcgcactaaatccccgtcccgac

SEQ ID NO: 23933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggttccttcacttcaggtccgctaggg

SEQ ID NO: 23934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgggttctagtttcgttcactttctccgt

SEQ ID NO: 23935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtaatcacgagaagtttcagagattcc

SEQ ID NO: 23936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtacgcaatgtgttcctaaaacgactt

SEQ ID NO: 23937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtagccggagtccctcgaagtttcccc

SEQ ID NO: 23938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtatgacgccgtcgataagaccccaca

SEQ ID NO: 23939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtcccatcctggagtgcaacaacctgg

SEQ ID NO: 23940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtcgcaagccgctcctcctcgggctcg

SEQ ID NO: 23941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtgcagcggcgagtcagctacatcaat

SEQ ID NO: 23942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtgcctgataggtcatggtgactctgt

SEQ ID NO: 23943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtggaggccgggaagcgtgggcgagga

SEQ ID NO: 23944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtgtcgcgactcggttagcgaattggg

SEQ ID NO: 23945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggtgtgatacttgccgtccccttcccac

SEQ ID NO: 23946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggttaatattattcctctaacagtgttg

SEQ ID NO: 23947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggttccgtgcacgagggctattgttact

SEQ ID NO: 23948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtggttgtccgtatagccccaaagactggt

SEQ ID NO: 23949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtaactagtaagtcttgtctttgaggac

SEQ ID NO: 23950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtaagcactcacacgtattgtatcatgg

SEQ ID NO: 23951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtaatcattttaataacacatgttattg

SEQ ID NO: 23952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtacagttgggactaatgccttcggatc

SEQ ID NO: 23953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtagaaagattaggtgcgggcccacgtt

SEQ ID NO: 23954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtagaccccatgttgctagtgtgctggc

SEQ ID NO: 23955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtagccgcgcggagaacgttttacgccc

SEQ ID NO: 23956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtagcgtgcagcttgtcggagcgtaatg

SEQ ID NO: 23957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtagcgtgttaactggcggtttagctgg

SEQ ID NO: 23958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtaggcaacccagtgttgggataaaacg

SEQ ID NO: 23959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtatgacattctggaagtggcaggttgt

SEQ ID NO: 23960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtatgtctgacggtctacaccccacccc

SEQ ID NO: 23961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtcaaattatccgcgacactgtaacgat

SEQ ID NO: 23962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtcaataattcggagtggttttctcctg

SEQ ID NO: 23963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtccaaatgtggtttcgttgacgactcc

SEQ ID NO: 23964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtccaggtggggggtttaatcttcccgt

SEQ ID NO: 23965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtcgcaagaacgtccagcatccagcgca

SEQ ID NO: 23966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtcgggttccgcataacggtgcgcgggt

SEQ ID NO: 23967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtcgtcagtacgtcgtgggctaaacatc

SEQ ID NO: 23968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgcacagtgccgatcgccatcagacca

SEQ ID NO: 23969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgcatgaagctcgtacaactggtactg

SEQ ID NO: 23970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgctcgcctaagattctgtagtacagg

SEQ ID NO: 23971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgctgggaacgacgtttttgttctagt

SEQ ID NO: 23972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtggaacgacacttcatgtctgtgatgg

SEQ ID NO: 23973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtggctctctttgggggcgttgaaacgg

SEQ ID NO: 23974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgggacatacttgagcgttatgatact

SEQ ID NO: 23975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtgtgcttctcagacctcttgcaatccc

SEQ ID NO: 23976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgttatgtaaagagaccgacttgaagagg

SEQ ID NO: 23977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgttccacaacagtggtaagcaggttgac

SEQ ID NO: 23978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgttcgcgggagttatcaagaccgcgtat

SEQ ID NO: 23979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgttgacgttaccgaccaggagcgcgacg

SEQ ID NO: 23980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgttggttttagtagtactacgtcgcttg

SEQ ID NO: 23981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtgtttagcatgcgcgcagtggtccttcgc

SEQ ID NO: 23982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaaaaggggcacggatatcgatgcgcgc

SEQ ID NO: 23983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaaaatgcaagtacgcgaatggcaatag

SEQ ID NO: 23984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaagacctcgtaccgcttttcgcccatg

SEQ ID NO: 23985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaagcgttgtaggtggctcgtattgacg

SEQ ID NO: 23986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaagggattcgctacaaacaacgctgga

SEQ ID NO: 23987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaagggcaatgtctagcacccttaggtg

SEQ ID NO: 23988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaatagcgtcctggccccttctcgcgta

SEQ ID NO: 23989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaatatcaggcgggaataaagcctttcg

SEQ ID NO: 23990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacacagcggatgcggattatgttgtga

SEQ ID NO: 23991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacatagcgcatgttttgtggcatggcc

SEQ ID NO: 23992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaccagtgcgaagggggagtgcacccgc

SEQ ID NO: 23993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaccatgtcccatccaatacccctagat

SEQ ID NO: 23994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttaccgtgggttgggacatgaggacgttt

SEQ ID NO: 23995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacctaggttgcacgtcaagcggctgag

SEQ ID NO: 23996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacctggttgcggagcacattccccgca

SEQ ID NO: 23997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacggtcaacacgagccttctttctcga

SEQ ID NO: 23998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacgttaggggtgcttaagccttccggc

SEQ ID NO: 23999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttactaattcgccgcgccagtcacgcaca

SEQ ID NO: 24000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttactcagggcggcacaagcgctgacgct

SEQ ID NO: 24001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttacttcagatccgcgttaccgcagggta

SEQ ID NO: 24002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagaccggttggatagatcccgtttgca

SEQ ID NO: 24003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagagccctgacactgaacgggtaatgt

SEQ ID NO: 24004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagagttccccagtttgctgacgtggcg

SEQ ID NO: 24005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagcattcgtgggacacagacaaacgat

SEQ ID NO: 24006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagccgtggctgtaaaggacagaagacg

SEQ ID NO: 24007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagggtatcgctgcgccacggtcgtgaa

SEQ ID NO: 24008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttagtagggccggctagtgggttcaaggg

SEQ ID NO: 24009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatcaggtgggccccgcgtatatgctgc

SEQ ID NO: 24010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatctatatgttcgacgagtcagcggtt

SEQ ID NO: 24011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatctcgctgacaagcccgcgcgtacgg

SEQ ID NO: 24012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatcttacgcccgctgaatatcccatca

SEQ ID NO: 24013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatgattatgttggaagttagaatcggc

SEQ ID NO: 24014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatgccgtaccattgggtgtgtactgta

SEQ ID NO: 24015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttatgctcgttatagaccggttgttcgta

SEQ ID NO: 24016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttattggtaaacgcttaagggttagcatg

SEQ ID NO: 24017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcaatatcgtttttctaggtttccgaga

SEQ ID NO: 24018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcacgggcaggcacggaatcgagtggct

SEQ ID NO: 24019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcagagatcatgccgacacgatgtgtag

SEQ ID NO: 24020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcagataaagccatttgttttgcgatcc

SEQ ID NO: 24021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcaggatcgcgtaatggtccgggggatt

SEQ ID NO: 24022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcagggattctggtaccccgcggatagc

SEQ ID NO: 24023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcatcatgtattacccaattcttcctgg

SEQ ID NO: 24024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttccaaacgcaggttctgtgtacgtcctc

SEQ ID NO: 24025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttccgattcatttcatttgttggtggtaa

SEQ ID NO: 24026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttccgctcgatcgagcccgccgcattgca

SEQ ID NO: 24027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttccggtttgctttggtattgcccacatt

SEQ ID NO: 24028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttccgtctgtatacccggcgacacaccgt

SEQ ID NO: 24029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgacgtactcgagccacagtccctatc

SEQ ID NO: 24030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgattgtatcgttggcttcttgagata

SEQ ID NO: 24031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgcccatcatgcgttctacaggggact

SEQ ID NO: 24032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgcgcttcggaagcacggcacacattt

SEQ ID NO: 24033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgctaagtgatgggcgttcgtccgtac

SEQ ID NO: 24034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgctggggctattaacctgtaaacctc

SEQ ID NO: 24035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgtactcccctagcctgtgtgcgatat

SEQ ID NO: 24036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcgtgttataaaaggcacgcgctttcgg

SEQ ID NO: 24037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttctatttctgtgttacctatttaggatt

SEQ ID NO: 24038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttctcatcaaagcaagctgatcgtctcta

SEQ ID NO: 24039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttctcatgtcacgctctcaccttcgaaag

SEQ ID NO: 24040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttctcggggattgatgacaagctttaatc

SEQ ID NO: 24041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttctgttcttacttcgtgcgatgtgaccg

SEQ ID NO: 24042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcttcaggatccgtggcatctaggcgga

SEQ ID NO: 24043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcttcctcagcagcctggacgctacacg

SEQ ID NO: 24044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttcttgaagcatcatcgttgacggagtgt

SEQ ID NO: 24045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgacaataggcgttgtcacccgagtccg

SEQ ID NO: 24046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgacattgtgtgataccaggaatctcca

SEQ ID NO: 24047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgacggaggcggttctggatgctttggg

SEQ ID NO: 24048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgacgtgcagctatggtttgggaacgcg

SEQ ID NO: 24049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgacgttttcgtgcgctattagacgagt

SEQ ID NO: 24050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgaggtttaagacgcttttacagcgacg

SEQ ID NO: 24051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgagtgatcacaagcttccttgcgcacg

SEQ ID NO: 24052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgatataacgacaatgagcagacggtcg

SEQ ID NO: 24053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgatccacgtgacagcaaggaagcacgg

SEQ ID NO: 24054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgatggggtttacccagagtatgcaagg

SEQ ID NO: 24055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcaaagtgcatcacatagcggattcca

SEQ ID NO: 24056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcaggtgcaataggaggctccttgtct

SEQ ID NO: 24057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcagtcgtgcggtgatgatttgtgcgc

SEQ ID NO: 24058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgccatggggtgccaggttggacgggta

SEQ ID NO: 24059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcccttgatctgccgtgcaagatggtg

SEQ ID NO: 24060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcggagtatggctactatgccgtgcgt

SEQ ID NO: 24061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcggcaggccttgctcggtttggtggt

SEQ ID NO: 24062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgcggtgcggtgttgaatcagcggctcg

SEQ ID NO: 24063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgctcgattcctcgtaggcgttcgacct

SEQ ID NO: 24064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgctggttgtgtgtacggggccttgcgt

SEQ ID NO: 24065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttggaaccattggagcgtgggtgggtcga

SEQ ID NO: 24066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttggacagtccccgtgttcggagtgccgc

SEQ ID NO: 24067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttggctgctggacccactttccccaccgt

SEQ ID NO: 24068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgggccccgagatccagggcggcgtggg

SEQ ID NO: 24069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttggtcagccgatgacggacaaaagacta

SEQ ID NO: 24070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgtgacggttggttgcgcacctttgcga

SEQ ID NO: 24071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgtgcgcaatcccattcatggctagtgg

SEQ ID NO: 24072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgtgggtactttacttccttctgactcg

SEQ ID NO: 24073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgttcgacctgttggtgtctattagtca

SEQ ID NO: 24074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttgttgtccttctttggattcgcggtaga

SEQ ID NO: 24075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttacgtaggcagggcgctaactggtgcg

SEQ ID NO: 24076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttactgggacgtgcttgggggacgatgt

SEQ ID NO: 24077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttagggtgcaattgtaattgctgtaaca

SEQ ID NO: 24078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttcagtatgagccagacacacgtgtccc

SEQ ID NO: 24079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttcagtgatttagggtactgaccactcg

SEQ ID NO: 24080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttcctccagctgcggccgcgcaaacttg

SEQ ID NO: 24081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttcgacgtaacagacctggaagttgtag

SEQ ID NO: 24082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttcgttcactagacaccttataagttgc

SEQ ID NO: 24083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttctcaaaccgtcaagtttgtatcttca

SEQ ID NO: 24084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttgacgagccgcgttgcgtctgcatcgt

SEQ ID NO: 24085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttgaggagtggtcgcaggcagtctagct

SEQ ID NO: 24086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttgcaatttttgctaggatcgggacctt

SEQ ID NO: 24087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttgccttgcgcttttcctggcccgggcg

SEQ ID NO: 24088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttgcgccttcctgttactagggtttatc

SEQ ID NO: 24089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttatgaagggagaacatgctggttgct

SEQ ID NO: 24090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttcaccatctgtagcctagagccctcg

SEQ ID NO: 24091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttctcgattgacctcttatgcttcttg

SEQ ID NO: 24092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttgacaaacgggtgagaccatggtgcg

SEQ ID NO: 24093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttgccgggtacggatactcgccaatgt

SEQ ID NO: 24094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgttttgtacccccgatcttgcttgactctc

SEQ ID NO: 24095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccgtttttcgtgaccaccattgtctggaaggg

SEQ ID NO: 24096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaaacattggcgtcatggcgcactgcaaa

SEQ ID NO: 24097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaaacgcgggcatgacgacctgcgcgtaa

SEQ ID NO: 24098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaaagtgttgagaatctgggggggcctca

SEQ ID NO: 24099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaacaagacggtggccctcaatgcgcgct

SEQ ID NO: 24100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaacggaagttccgtgcggtaggattccg

SEQ ID NO: 24101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaactgcttggggtcgatgcgggtataac

SEQ ID NO: 24102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaagaatgcgttctgacgttgtggtccgt

SEQ ID NO: 24103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaagggtgcagaggttgatgcctgcttgc

SEQ ID NO: 24104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaagtgcacgtctatgtgtgggcagccac

SEQ ID NO: 24105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaagtttagctctcgttcctttgggttcg

SEQ ID NO: 24106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaagttttgagcagaacggagtcagcgcc

SEQ ID NO: 24107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaatcagtttctttctgccgacgtcgcac

SEQ ID NO: 24108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaatcggcgtttaaaacgaattgtctaca

SEQ ID NO: 24109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaatcgtatactagctaccaggcatctgg

SEQ ID NO: 24110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaatggaagcagtttagctgtccttcgtg

SEQ ID NO: 24111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaatggatggtctgcacagttagacagtt

SEQ ID NO: 24112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacaaacccgcttagctacgctcggttag

SEQ ID NO: 24113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacaattgtgtagtacaacggaccgcggg

SEQ ID NO: 24114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacagcgagactcatatgcagaattgtat

SEQ ID NO: 24115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacatggctttggttctggtatgctaggt

SEQ ID NO: 24116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacccatgccgcatatgtgctcaacgtcg

SEQ ID NO: 24117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacccggttactgtgctcgtgattcttat

SEQ ID NO: 24118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacctcggtatggcacgttgggtccggta

SEQ ID NO: 24119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacctggtttgctgacactgtgccttgtt

SEQ ID NO: 24120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacctgtctatcaagtgacaaaacgggtg

SEQ ID NO: 24121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacgcgaatgggttcaacccactctgccg

SEQ ID NO: 24122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacgtcaagctcccgtccgtaaatgcctc

SEQ ID NO: 24123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacgtgagttggatctcaaccttctccat

SEQ ID NO: 24124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaactagagtcccacttgacagtcacgggc

SEQ ID NO: 24125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaactcggttatattccccttctgacgtag

SEQ ID NO: 24126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaactgcaggcgggtaggcgctaggaccaa

SEQ ID NO: 24127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaactgtggaacgaaaatgtctcgctatta

SEQ ID NO: 24128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaacttgaacaactgtcttggagatgtccg

SEQ ID NO: 24129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaactttgaatctgtgggttatccgatgag

SEQ ID NO: 24130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagacaccacgatcactataacttctcat

SEQ ID NO: 24131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagaccgttcggactgtcccgtctatgtt

SEQ ID NO: 24132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagataatgcgggtgagagtggtcgcgcg

SEQ ID NO: 24133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagcacaacgcatgattgcagcggtagtc

SEQ ID NO: 24134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagcagcgcgtgtcgacatacgtgcggtg

SEQ ID NO: 24135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagccggccgtctgcaaagcctttcgcgt

SEQ ID NO: 24136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagctcaagaagcggtccgggctccatga

SEQ ID NO: 24137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaggaacggtcgccccgcctgcgaagtgt

SEQ ID NO: 24138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaggcgatcgtcaactatttgtccttggt

SEQ ID NO: 24139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagggattcgatgggcagccatacgcggg

SEQ ID NO: 24140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagggccgcacagagcggtaaacagtcat

SEQ ID NO: 24141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagggctgtggcagttgatttaggggcgg

SEQ ID NO: 24142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaggtactggggggcagggatacgggaag

SEQ ID NO: 24143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaaggttgagagccgcttgaataagtacac

SEQ ID NO: 24144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagtcatcagagacctttaatgtcgtcgc

SEQ ID NO: 24145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagtgcgtcataggagaggacgagacggt

SEQ ID NO: 24146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagtgtaacacactgtctatgccagtggg

SEQ ID NO: 24147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagtgtcctgacgtaagctccggagtcgc

SEQ ID NO: 24148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagttttagtaaattttagaccatttcgg

SEQ ID NO: 24149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaagttttagttttgcttaaatccggtctc

SEQ ID NO: 24150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatatcgcagtacctcggcgcgcaggagg

SEQ ID NO: 24151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatcagaatggacatgcatcctaactcat

SEQ ID NO: 24152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatccagtagtgaaattgggtgattctat

SEQ ID NO: 24153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatcgccagcatataaggcggactctact

SEQ ID NO: 24154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatcggggctatcccgctccatggtactg

SEQ ID NO: 24155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatgaacgggttacggggtgagacaacct

SEQ ID NO: 24156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatgaaggcaagcaaggacgtatcagcac

SEQ ID NO: 24157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatgaaggctcagaggatgggcggccagg

SEQ ID NO: 24158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaatgtctcttttcacccgcctgtatgggt

SEQ ID NO: 24159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaattagcagtttctcgccttactccatgg

SEQ ID NO: 24160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaattcccggacttaaattgcttcccactc

SEQ ID NO: 24161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaattgcctttggcggaaagtcacagccca

SEQ ID NO: 24162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacaacagcagacctcgtcacaggaagtat

SEQ ID NO: 24163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacaaggtggtgcgaggactttcaggggct

SEQ ID NO: 24164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacaattcttcgtaaaaggtttcccacgcc

SEQ ID NO: 24165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacacactctaagcgtatggtgaatattcc

SEQ ID NO: 24166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacaccggtccgagcgcagcattctagctt

SEQ ID NO: 24167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacacgcctgacgatgggattacgggagtt

SEQ ID NO: 24168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacactggtcaaagtccggaatgtcgttag

SEQ ID NO: 24169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacactgtaatccaaaatacctgatggcgc

SEQ ID NO: 24170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacacttcgattgtgcttagagggctggtt

SEQ ID NO: 24171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacagaacttattaatcagtgtcgtaatga

SEQ ID NO: 24172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacagtatgcaggactcctaggctcgcatt

SEQ ID NO: 24173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacagtgccatcaacagcagtgctgttgcg

SEQ ID NO: 24174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacatcactttcgcttcggatgccataatc

SEQ ID NO: 24175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacatctaacgcctatcatttagatcgagt

SEQ ID NO: 24176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacatctttttccggatggatggagacgat

SEQ ID NO: 24177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacatgcgataggccgccttcgttcgttca

SEQ ID NO: 24178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacattcaggcgcctttcgcagaaaaacgg

SEQ ID NO: 24179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccacaggtggtcaactttacatattggc

SEQ ID NO: 24180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccatgactaaggtttaccgctcgtcagc

SEQ ID NO: 24181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccattgggcattaatttgggcggcgttg

SEQ ID NO: 24182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccaaagggagttgcagccacgcgatat

SEQ ID NO: 24183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccaatctttagccaggccagtatttgt

SEQ ID NO: 24184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccatgcaggtgatcgtcaacccgatta

SEQ ID NO: 24185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccctcctctgcgaaccgtggccggccg

SEQ ID NO: 24186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccgacggggcgaggtcctctaggggcg

SEQ ID NO: 24187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccggatgtatcatttcaacgcatgtga

SEQ ID NO: 24188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacccgtcgccggaaggtgcatcaggtccg

SEQ ID NO: 24189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccctgcctgaactacataaggtgcgtgt

SEQ ID NO: 24190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccctttatcaaaccctttacgcaagtgc

SEQ ID NO: 24191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccgcaagcatagaagtttgctgggcaga

SEQ ID NO: 24192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccgctgacggcctgaaagcggtgcccgt

SEQ ID NO: 24193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacctagaaaatattaagtacgccaaatgg

SEQ ID NO: 24194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacctgaaagaccctcctcggtttatccgg

SEQ ID NO: 24195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacctgactgtgtttacgggtccggatgct

SEQ ID NO: 24196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacctggccagccgtctaatacgctccggc

SEQ ID NO: 24197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacctggcgcggacggctatttcacgggga

SEQ ID NO: 24198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaccttaatcgctcaacgataacgagtagt

SEQ ID NO: 24199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgaagcacgcgactaatagttcgaacgc

SEQ ID NO: 24200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgactggtgcctctggggtggcgtgtta

SEQ ID NO: 24201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgagatgtggtgagggtccggaagcagg

SEQ ID NO: 24202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgagggttctttatttgcgccagggcta

SEQ ID NO: 24203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgagtcaagcggatcattcgtcatgcgc

SEQ ID NO: 24204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgatacggaactgctgaattaccctatg

SEQ ID NO: 24205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgattaccataacgtgtttacttgagga

SEQ ID NO: 24206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgcactccctgacatttgtatgcggtcc

SEQ ID NO: 24207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgcagacccgcagtataactcggcttta

SEQ ID NO: 24208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgccgcaaaaacggattcgagaccccct

SEQ ID NO: 24209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgcgacagcatcgctagattgacaggtg

SEQ ID NO: 24210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgcgacggattaatccctgcctaccacg

SEQ ID NO: 24211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgctgcgaaccctgtggataccccgtgt

SEQ ID NO: 24212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgcttcccccgagtgcgaaatctacctt

SEQ ID NO: 24213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgctttcttggacatacccgtatggttt

SEQ ID NO: 24214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacggacgctgatccgcatggtattggggt

SEQ ID NO: 24215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgggacgtcgaccgctcattcttggtgg

SEQ ID NO: 24216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgggcttaggatgagtcagtgtaattag

SEQ ID NO: 24217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacggggacaaggggaccggctaggattgc

SEQ ID NO: 24218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacggggagctgtccattaagcgtgtttcg

SEQ ID NO: 24219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacggtgtaccgcttgctccaggatggctt

SEQ ID NO: 24220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacggttcagttgcgttcagttccgcgaca

SEQ ID NO: 24221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgtcgtacattgatatttactcgtgttc

SEQ ID NO: 24222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgtggtatatacagccctcccaccgcgg

SEQ ID NO: 24223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgttctggtagttgcaactgcgtaatga

SEQ ID NO: 24224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacgttttggtctgcgcaaattggtacgct

SEQ ID NO: 24225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactaaagactattacgggctccgtctcct

SEQ ID NO: 24226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactaagccaagtctctccgcacgggggaa

SEQ ID NO: 24227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactacacgcggcgccggtcaccctgttcg

SEQ ID NO: 24228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactacgtgggttgttttcggatggccggt

SEQ ID NO: 24229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactcactgtcttgctcaataagttccgat

SEQ ID NO: 24230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactcatcaccgtggtactgtgcgttgttc

SEQ ID NO: 24231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactcggcgacaacagtcactccggcctct

SEQ ID NO: 24232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactcgtcacttcgaacccgcgtaatcgag

SEQ ID NO: 24233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactcgtggggaacatgttaatggatctga

SEQ ID NO: 24234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactgattggcttacactttaaagaattag

SEQ ID NO: 24235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactggagtaagtgcaccttcagggatcac

SEQ ID NO: 24236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactggcgcggaggtaattggcaagtgata

SEQ ID NO: 24237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactgttgatgctgacgaaggctggccatt

SEQ ID NO: 24238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttactgcgaacaccttttcttggtcta

SEQ ID NO: 24239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttcattatcccttcctcccgcagacct

SEQ ID NO: 24240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttcgagcatcgtgcgtttccacggtat

SEQ ID NO: 24241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttcgggtacggggatgtatcaatgtgt

SEQ ID NO: 24242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttctgtgaaggaccctctggctcgggg

SEQ ID NO: 24243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctactttggtattgcagtatttgtttgcgta

SEQ ID NO: 24244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttttatggatgggccgtttgcttgccg

SEQ ID NO: 24245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctacttttcggctggtactctcgtatccggg

SEQ ID NO: 24246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagaacgtcactacatgcatgaatggatgg

SEQ ID NO: 24247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagacaagatgtttcaaagtgcactggcgt

SEQ ID NO: 24248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagactccatggacagggttcgacatagcc

SEQ ID NO: 24249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagatcaccgttatgcataactaaatgg

SEQ ID NO: 24250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagccggggatcaagccatgagcacatt

SEQ ID NO: 24251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagcctttagggttcttatactctagcc

SEQ ID NO: 24252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagctcgatcgggtgtctagctatccgg

SEQ ID NO: 24253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagtatctgactgtccgctgcgtccctg

SEQ ID NO: 24254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagtccgtcgtagagtgttcttgggcat

SEQ ID NO: 24255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagagtgcttctattgcagctgattgccga

SEQ ID NO: 24256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagatacagatttttaggctgtctgtctac

SEQ ID NO: 24257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagatacggagggcggtgggttgacagttt

SEQ ID NO: 24258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcaatcaggagcttaacgccttcggcct

SEQ ID NO: 24259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcactacacaatgtagcatcggcgcttt

SEQ ID NO: 24260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcacttgcacgtcggagtagggttatgt

SEQ ID NO: 24261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcagcttcacccattgacccgccgacga

SEQ ID NO: 24262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcagcttggccaaccctcgatgacagcg

SEQ ID NO: 24263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcagtgatctgcacgcccaacgtcactg

SEQ ID NO: 24264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagccatcacctcgtggattgcggctactc

SEQ ID NO: 24265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcgacgtctaatgtccacgcagcacggg

SEQ ID NO: 24266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcgattggtgtgatgtgcaaattgggca

SEQ ID NO: 24267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagcgcataagaggagcagacattcacatc

SEQ ID NO: 24268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagctcagaatctgggacctcttcgtgtgg

SEQ ID NO: 24269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagctccaggatatggtcgcaccgggacta

SEQ ID NO: 24270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagctcgacacttccgctctataggagttg

SEQ ID NO: 24271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagctctcgtagtataattcccctcctaag

SEQ ID NO: 24272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggaagagggacttgaatagcagctgtat

SEQ ID NO: 24273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggaccgttgtatgcttgcggggtacatc

SEQ ID NO: 24274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggagacgtgttgttaggttcgtatcgtc

SEQ ID NO: 24275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggaggcgcattgatgtgttggatccgcg

SEQ ID NO: 24276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggagttcgcaagggtagccatggtcagg

SEQ ID NO: 24277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggatctcaatctggactgcctagctaac

SEQ ID NO: 24278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggatgggacgtccatcggaattggttgc

SEQ ID NO: 24279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggattactcaaaggtctcgagattgccg

SEQ ID NO: 24280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcaatttacttgatatctcactacaac

SEQ ID NO: 24281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcacgccatgtgtgtacgaagacgcta

SEQ ID NO: 24282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggccccgatcgtggacccgccctggaat

SEQ ID NO: 24283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcccgtctgtgtgatacgctccataag

SEQ ID NO: 24284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcgaagcgctcgaggtggtggatgtcg

SEQ ID NO: 24285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcgctcaacatagcaaatcaatgactg

SEQ ID NO: 24286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggcggggttgggatcaagggacgcggtg

SEQ ID NO: 24287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggctaacaactcgttccatatggatttg

SEQ ID NO: 24288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggctcaccaaactggacaacgggcgtcg

SEQ ID NO: 24289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggctccgtaatttgagcgcggccaaggc

SEQ ID NO: 24290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggagatctggcaaaccgctcaatggtg

SEQ ID NO: 24291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggatgcccgtggtctacgaacatgcgg

SEQ ID NO: 24292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggattgttgggagaccgacatgtgcgg

SEQ ID NO: 24293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggcaccacgggggtctttaggtccaac

SEQ ID NO: 24294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggcgcacgcggggctgcgtaggtggct

SEQ ID NO: 24295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggcttgttaattactaactctgcttcg

SEQ ID NO: 24296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggggaatttctcatcgtgggatgaagct

SEQ ID NO: 24297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggggtccacgatcagatggtacactctt

SEQ ID NO: 24298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggggtcggcagttactgatgattggatc

SEQ ID NO: 24299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagggtcgcggtgtgcatcgtttacatgcc

SEQ ID NO: 24300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggtacgtagattacttacagtattgtct

SEQ ID NO: 24301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggtccaactcttgcacttgcgagccgga

SEQ ID NO: 24302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggtggaggggggtgtcttcccgcatttg

SEQ ID NO: 24303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctaggttgccggatgatgtttcttcacggtt

SEQ ID NO: 24304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtacagtgttacggactagtttctcttg

SEQ ID NO: 24305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtagacgagtgcgttggcagctgtgacc

SEQ ID NO: 24306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtaggtcaggtaaacttattggggaata

SEQ ID NO: 24307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtcaccacagtgagaggagcttgaggtg

SEQ ID NO: 24308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtcccactcattgtccgaggtgcgcggc

SEQ ID NO: 24309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtcgcatgcgactcattgtgtttcatcc

SEQ ID NO: 24310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtctatagcttcgtcatgtctttagcgg

SEQ ID NO: 24311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtctctccgtgctcgctcccaatagttc

SEQ ID NO: 24312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtgcttcgaatctgtaagccgttcgtgg

SEQ ID NO: 24313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtgggcaggttccccggccacgtgactg

SEQ ID NO: 24314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtggtcactccatcttccgcctcagctc

SEQ ID NO: 24315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctagtgtgtagcatgcaaaaatcttgtcttg

SEQ ID NO: 24316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctataacggctgccagtgcatatcggcgcga

SEQ ID NO: 24317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatacaagggtatcagtagatcgtttctta

SEQ ID NO: 24318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctataccggtgtacttggttcgcgtactttg

SEQ ID NO: 24319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatacggtgccaagtcaaccgacccgagcg

SEQ ID NO: 24320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatacgtgcttcttagtgtctggcaatgct

SEQ ID NO: 24321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatagccggcgcggacaggcgttacttgcc

SEQ ID NO: 24322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatatcagctaaaggtgttagtttcgatgt

SEQ ID NO: 24323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatatggaggaggagaggccttcccgactg

SEQ ID NO: 24324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatatttactcgcggatcgtaattctcggc

SEQ ID NO: 24325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcacacaattggttgccgcggtttatgt

SEQ ID NO: 24326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcagaccatttgtgcaattcctaggttt

SEQ ID NO: 24327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcatcatgctccgatcttttgggatatc

SEQ ID NO: 24328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatccatgaatttcgctgttccacgacatg

SEQ ID NO: 24329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatccccgcccaaaacgcgcgagggcttgc

SEQ ID NO: 24330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatccctgcgaacgtttattacgtctcggt

SEQ ID NO: 24331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcgaaagctctctcggctttgcctgcaa

SEQ ID NO: 24332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcgtatcttaaccgaggtggccttaagg

SEQ ID NO: 24333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatcgttcgaatgctagtctactttccgtc

SEQ ID NO: 24334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatctcaagtagttccccgtctcatttacg

SEQ ID NO: 24335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatctccgggtgcttattccggctcttctc

SEQ ID NO: 24336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatctcttcttatgttacgtgcggattttt

SEQ ID NO: 24337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatctggtccgacgacgcacgccatggagt

SEQ ID NO: 24338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgaacgggtgatgaagcgaggggaccac

SEQ ID NO: 24339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgaacttgaggcgtatccagcaagagcc

SEQ ID NO: 24340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgaagcatattttgcgtgatgatgcgtg

SEQ ID NO: 24341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgaccttgtaagggggtgtgccgatggg

SEQ ID NO: 24342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgacgggtgcctcgacgttggtttggcc

SEQ ID NO: 24343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgagatggatcttaaagagcactacatc

SEQ ID NO: 24344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgagtgtctcagttcggttgtggggaga

SEQ ID NO: 24345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgatgccatgcgccgagtccattcacgc

SEQ ID NO: 24346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgattttaccgtacgggacatacaggga

SEQ ID NO: 24347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgcgaccatcacaagaggcatagccctg

SEQ ID NO: 24348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgcgaggtaagtaccctctcgtttgtgg

SEQ ID NO: 24349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgcgcggccggggtgatgcacggactcg

SEQ ID NO: 24350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgcgtatgtccatgtgaagcagcggtgc

SEQ ID NO: 24351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgctgggatacgctaccgggtcctttgt

SEQ ID NO: 24352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggatcaggcggtatgagcccggcattc

SEQ ID NO: 24353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggctcggtcgtggtgtagtggctttga

SEQ ID NO: 24354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgggaggccgtttgaagatcaatgcctg

SEQ ID NO: 24355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggggggcttctcgtgcgcacacagtgc

SEQ ID NO: 24356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggtagcgtgcagacggtgggattaccc

SEQ ID NO: 24357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggtggtccagcgtgttgggggagacgt

SEQ ID NO: 24358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggtggtttcctggtagcactgcgatgc

SEQ ID NO: 24359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatggtttgaatggttccgtggaccgatac

SEQ ID NO: 24360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgttccacgatcaaacgttaccgtatac

SEQ ID NO: 24361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatgttcgtcaataggtgtggccttttggg

SEQ ID NO: 24362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattacgcggatttatcgggccgtccttag

SEQ ID NO: 24363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattatcccgcccaatttaactatgacgct

SEQ ID NO: 24364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattattcttaaggattgggttttattgcg

SEQ ID NO: 24365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattcttgcgccctggctcgttgggggtcc

SEQ ID NO: 24366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattgacacgggacgatgtttactggtatc

SEQ ID NO: 24367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattgatctggacatttttcgttagtatgg

SEQ ID NO: 24368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattgggaaaaccgtcgtcattttatacgg

SEQ ID NO: 24369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatttagactcgtcgaactgtttccacctg

SEQ ID NO: 24370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatttcttcgtaactgttcattttgaggca

SEQ ID NO: 24371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctatttgatgcagtatggctcactgaaagtg

SEQ ID NO: 24372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctattttactacgcccgttactttcttatct

SEQ ID NO: 24373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaacggagatccacaaattgcgtcgctg

SEQ ID NO: 24374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaagagtgggttggttgcgtgacccctg

SEQ ID NO: 24375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaaggataaccatacgtccggcgattaa

SEQ ID NO: 24376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaagtccgaccttgctgctagcgccacc

SEQ ID NO: 24377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaccagtactgatcaagtgctggtgcca

SEQ ID NO: 24378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaacccgcgaaagcattgcagtgatggtc

SEQ ID NO: 24379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaccctgtttcacaggtttggcgtcacg

SEQ ID NO: 24380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaacctacgatcgagtgtcggactggttt

SEQ ID NO: 24381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaactcggtcgatatgattccggcggatg

SEQ ID NO: 24382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaagaatgatcggggggatctgtgcggcg

SEQ ID NO: 24383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaagagcagacgtgaaagcgcccgttgtg

SEQ ID NO: 24384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaagctctagcacattggcagtcctcttc

SEQ ID NO: 24385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaaggagtgctcggaagctggtgatatgt

SEQ ID NO: 24386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaatcactaggcttcatgtgtcgctgcgt

SEQ ID NO: 24387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaatgctcccgcggcgcatgggtcgtgga

SEQ ID NO: 24388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaatggcgagaccaaggtcaaagcatgga

SEQ ID NO: 24389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaatgttagctccgcagaagtgaaatgtg

SEQ ID NO: 24390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaatttggttccttggcatgtacaacatc

SEQ ID NO: 24391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacaatctggtctctggtagggcaccgcc

SEQ ID NO: 24392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacacggggctatgctgattttaccgtca

SEQ ID NO: 24393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacacttgtacacagtaccaaagtcccgg

SEQ ID NO: 24394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacaggttacggatcgccccacgatggtc

SEQ ID NO: 24395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacatcggatcgcggagaaacgaaggatt

SEQ ID NO: 24396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacattacgagaaacgactatcatttgac

SEQ ID NO: 24397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacccagtaaattcccgtgtacgacggtt

SEQ ID NO: 24398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacccctctttcgaccgactctcgcgtaa

SEQ ID NO: 24399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacgaaacttgttgttggacaacgggact

SEQ ID NO: 24400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacgaccggcacactcagagacggcgatt

SEQ ID NO: 24401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacgagtattttctggcaaaacggggcgt

SEQ ID NO: 24402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacgcggggaggaatgccaccaatacgtc

SEQ ID NO: 24403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacggtaaacgtcaggtctgagtctgttg

SEQ ID NO: 24404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacggttagagcgatcgtattgcaccaaa

SEQ ID NO: 24405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacgtccgcaattgagattcataggccgt

SEQ ID NO: 24406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactattcagccactgttggatcgtaccg

SEQ ID NO: 24407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactcacccttttggtcagtgccgaaggg

SEQ ID NO: 24408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactcgtttcgtttcgtatgcctttgcct

SEQ ID NO: 24409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactgatgttggctggttttggctccaaa

SEQ ID NO: 24410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactgccggaagctagtgaatcatagccg

SEQ ID NO: 24411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactggcttcaatatcaagggggcatcaa

SEQ ID NO: 24412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcactgtcattgcaaatcgactcagagggt

SEQ ID NO: 24413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcacttgccgctcgtcgatgcagctggtaa

SEQ ID NO: 24414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagaaagcgtgtcacttgacggaagactg

SEQ ID NO: 24415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagagagggttgcgacccgccgaacgctg

SEQ ID NO: 24416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagaggcaattccgggactctgctaatgt

SEQ ID NO: 24417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagaggttcaggacttcgcgtaccacatt

SEQ ID NO: 24418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagatcaataaatgtcataaatgttaagg

SEQ ID NO: 24419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagatggttatgtagtacccggcctgccc

SEQ ID NO: 24420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagattgtgcgatttttggtttgtatctt

SEQ ID NO: 24421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagccagtaggttgcaggttcaactgcat

SEQ ID NO: 24422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagcgcggaggcacgaagtcgcaagtata

SEQ ID NO: 24423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagctatgctctcagggacatgtgtgcca

SEQ ID NO: 24424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagctcaatatgtctagcctcagccttcc

SEQ ID NO: 24425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagcttttattccagtctatgacgggctc

SEQ ID NO: 24426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggaactgtcaacttttacgcgcctata

SEQ ID NO: 24427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggcgctcgcgtcgcgacatggcggtgc

SEQ ID NO: 24428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagggaacatgaccgtgttctcaccgtga

SEQ ID NO: 24429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagggacatacgacccagttctttgtagt

SEQ ID NO: 24430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggtaaggctaacggggaagggcgtagg

SEQ ID NO: 24431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggtctgctccatttgcaatctcaggag

SEQ ID NO: 24432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggtgagaacgtcttacctgatagtgcg

SEQ ID NO: 24433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggttattcagtcttgcttcactcggtc

SEQ ID NO: 24434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcaggttcgagggactgtctacacatacac

SEQ ID NO: 24435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtaacttgcgcgcggctcctcgttcat

SEQ ID NO: 24436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtatcaagatgcagggtttgacggcac

SEQ ID NO: 24437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtccctccgagagcgtgcggctgctcc

SEQ ID NO: 24438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtcgaattgcgggagagtttccgcgta

SEQ ID NO: 24439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtgatataggccagacttaatctcaac

SEQ ID NO: 24440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcagtgtatacctgtgcgaacacgcttcat

SEQ ID NO: 24441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatacccagaggtcgcaaatctgtccgtt

SEQ ID NO: 24442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatacgactggggatgtctgtcggtgtta

SEQ ID NO: 24443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcataggtgaggcttgtgcgactaatgggg

SEQ ID NO: 24444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatatgcgaacaacccactagtccaggct

SEQ ID NO: 24445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatccgggtgcacaaagtcaaaaagtggt

SEQ ID NO: 24446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatcggagatggcatacgttgcgtagctt

SEQ ID NO: 24447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatctcgttacacacccacgagctaccat

SEQ ID NO: 24448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatctgacaccggagccagcctgactacg

SEQ ID NO: 24449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatgagtcatgcttcccgcaatttcgatc

SEQ ID NO: 24450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatgatagatttccgaccacccttttagc

SEQ ID NO: 24451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatgcggatagtacataaaggcgggtata

SEQ ID NO: 24452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatggtttgccatcagtttaaacggcgga

SEQ ID NO: 24453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcattaccgacgcactcattttcgcatcgg

SEQ ID NO: 24454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcattatcgtagtctgtaatacttcgtcga

SEQ ID NO: 24455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcattctctagtggtacgtcgcaacatgta

SEQ ID NO: 24456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcatttctcgtcccccgttgaccttccgga

SEQ ID NO: 24457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccaacgtgatacgtgttcatcgcatgcgt

SEQ ID NO: 24458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccaacgtgtcgccatgtgcatgggtagtt

SEQ ID NO: 24459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccaagcagatggtggcaagttagcactat

SEQ ID NO: 24460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccaagtaacaatgtattggaacagacctg

SEQ ID NO: 24461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacacagagcaggtgattgagaccggta

SEQ ID NO: 24462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacactactcaccgggacagggtgaacg

SEQ ID NO: 24463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacccttgcgattattagacattttccg

SEQ ID NO: 24464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacgcgcgcgcaacgttcggctttctgt

SEQ ID NO: 24465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacgtcattcttgaatttgtagatatca

SEQ ID NO: 24466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacgtgcacttacattccgtatgttgtc

SEQ ID NO: 24467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccacgttcgtgatcgttcatgggacgtcc

SEQ ID NO: 24468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccagcgtaccgttcttctcttgggacatt

SEQ ID NO: 24469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccagggggcaccacgactcgcggcattgc

SEQ ID NO: 24470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccatcgctttgtacaagtttccgcgctcg

SEQ ID NO: 24471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccatggtgaaaccgtctgttcaggtgtgg

SEQ ID NO: 24472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccatgtatacaagatctggcctttgaagt

SEQ ID NO: 24473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccatgtgaaactatgcgctaaggctgagg

SEQ ID NO: 24474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccattaggttgcgatctggtcactcgcca

SEQ ID NO: 24475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccattgcccaaatacagcgcttgtactca

SEQ ID NO: 24476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccattgtgatgtatggcgggaccttggtc

SEQ ID NO: 24477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccacgctgcgtgcatgtcttaacccacg

SEQ ID NO: 24478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccacggtattacgtcggacgctgtattg

SEQ ID NO: 24479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccactcccggcatagtgatggtttaaac

SEQ ID NO: 24480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccactttagcatgttacgttgttcgtcc

SEQ ID NO: 24481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccccaagcaagaatgggattgtgtctgtc

SEQ ID NO: 24482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccccagctctcaaatcgacatgacctatc

SEQ ID NO: 24483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccccagacgcaggttctcacgtggttgc

SEQ ID NO: 24484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccccgcgtccgtcggttgtttatcctagg

SEQ ID NO: 24485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccccgctccgagggcattatctgtcgggt

SEQ ID NO: 24486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgacgagccgagccaaacaatcgaggg

SEQ ID NO: 24487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgacgcctgccttggtaccagaacctc

SEQ ID NO: 24488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgatattaacattcaggcgcgtgttat

SEQ ID NO: 24489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgatcgttccacgttgatagtgtttcg

SEQ ID NO: 24490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgctggcaacggtattgcgctatggct

SEQ ID NO: 24491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcccgggtagtcgtagcggtcgcttgcgtg

SEQ ID NO: 24492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccctcatggacgtggattggttacgttgg

SEQ ID NO: 24493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccctcggggcaaattggcacctatatgca

SEQ ID NO: 24494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccctctaccgccgtatgacttctgtgagt

SEQ ID NO: 24495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccctgcagcccacaagaccgaaaatctcg

SEQ ID NO: 24496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgaccggccgcctgatttgatgtgtcgc

SEQ ID NO: 24497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgaggtttcgcgatgtgcggtggttgct

SEQ ID NO: 24498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgatccggcgagggggtaagcgcggtgt

SEQ ID NO: 24499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgatgagttcatagcgcttcggtcaaaa

SEQ ID NO: 24500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgatgtccgggtctttattgatggctga

SEQ ID NO: 24501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgattacaccggaaaccgctccttgcgc

SEQ ID NO: 24502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgcagctcgtgtacctcgtggcaatagc

SEQ ID NO: 24503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgcgtacctgacgaccaacggtaccttc

SEQ ID NO: 24504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgctactacggtcctcaaggcgcgggca

SEQ ID NO: 24505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgctcactcttctattgatgtgtcattg

SEQ ID NO: 24506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgctcgtctctaagatgtccatgtggaa

SEQ ID NO: 24507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgcttcataacgccggccgtgtttcgca

SEQ ID NO: 24508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggactccatgctgcccgcgacttgtac

SEQ ID NO: 24509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggagagggtcttctagtggcaaccccg

SEQ ID NO: 24510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgggggatcatgctcggcccaacaactc

SEQ ID NO: 24511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggggttgttcaagagtatgacctttga

SEQ ID NO: 24512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggtactttcattgggctctgggctgta

SEQ ID NO: 24513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggtgccattacgtagacgcatgcacgt

SEQ ID NO: 24514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccggtgtttagtcttacgttcctttgcac

SEQ ID NO: 24515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgtagaccttagatcgcggagttaaagg

SEQ ID NO: 24516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgtcacgcgggtattagctgtcgcaggt

SEQ ID NO: 24517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgtcgtttgggttaacgcactgcgcgac

SEQ ID NO: 24518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgtgaaaggctctgcgactgcagggttg

SEQ ID NO: 24519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgtgctgctaagattattccgtatcggt

SEQ ID NO: 24520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgttccaaacacgttactagtagcgggt

SEQ ID NO: 24521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccgttgtcccaccatctgaactatatctg

SEQ ID NO: 24522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctaaaagctaaacataaccatgcgccca

SEQ ID NO: 24523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctccgaagttgtccggctaatgatcggg

SEQ ID NO: 24524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctccgctcccttctctattgttcgtcga

SEQ ID NO: 24525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctcgggtaactcaacacatcaacaatat

SEQ ID NO: 24526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctctttttccgggctcgcgaaggctact

SEQ ID NO: 24527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgactgccaaggaatagcaaatatcgg

SEQ ID NO: 24528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgattgggtgcttaatcaatacattgg

SEQ ID NO: 24529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgcaagactcccatgatcgctcatctt

SEQ ID NO: 24530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgcggctgttagatccttcgaagcgta

SEQ ID NO: 24531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgcgggcagaacgaccagagacagggg

SEQ ID NO: 24532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgggagaacgctcggccatacgcttac

SEQ ID NO: 24533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgggggtgtggacctcatgcatacggg

SEQ ID NO: 24534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgtcacagaacggcacgtttagacgtc

SEQ ID NO: 24535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgtcaggtctccggctgcttggttccg

SEQ ID NO: 24536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcctgtctttgatcgcttccgatgccatgt

SEQ ID NO: 24537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccttagagatgtagtgcttacatggatac

SEQ ID NO: 24538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccttccacgacaggttcaatcccctactg

SEQ ID NO: 24539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctccttccttgcgtgctattggtgtcatgtt

SEQ ID NO: 24540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaaattcggcgggtttgattggctcttt

SEQ ID NO: 24541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaagcccggctaaataggagggccatcg

SEQ ID NO: 24542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaataaacgaccagagccagtgcgggcg

SEQ ID NO: 24543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgacacgttttaaaatgaaccttcaccga

SEQ ID NO: 24544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaccagcacctgtatgtcccgtacgagt

SEQ ID NO: 24545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaccgcgtcaacttgcagctggggcgcc

SEQ ID NO: 24546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgacctccaggtagagaggtctttcacgc

SEQ ID NO: 24547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgacgccgtgtagatttggggactcggcc

SEQ ID NO: 24548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgacgcgccgtagatcaccctatcaggct

SEQ ID NO: 24549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgacgggttatggttcgtaacgtcacgcg

SEQ ID NO: 24550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgactatgccgttcaataacccatccatt

SEQ ID NO: 24551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagcaccttggaagcagcggtcgacgtg

SEQ ID NO: 24552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagcagacataatgctctccattcggtc

SEQ ID NO: 24553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagcgcttgaaggcaatcacatccgatg

SEQ ID NO: 24554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagcggattcacggttctttgtctactc

SEQ ID NO: 24555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaggaagcctacgcattcgacttgaaga

SEQ ID NO: 24556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaggattacgggcgcgtagatttggtgc

SEQ ID NO: 24557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaggcacgttggtttgtgctaaactgcg

SEQ ID NO: 24558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaggcatgacacgaactaaggcttgctc

SEQ ID NO: 24559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgaggcgatgtactccgtgtctttttccc

SEQ ID NO: 24560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagggcgtacataaggcgtactcatctc

SEQ ID NO: 24561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgagtcctaggctttgcatgcttttcctc

SEQ ID NO: 24562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatataggctcatacccggctggtgttc

SEQ ID NO: 24563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatcctcgcaattgcggcgctatgattg

SEQ ID NO: 24564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatcgtcggttgtgacctgtattctcgg

SEQ ID NO: 24565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatgaagcgttacgcacacgggtcaggc

SEQ ID NO: 24566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatgactatgaggaccgctggattgcac

SEQ ID NO: 24567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgatttctctggaaggccctcgatgctag

SEQ ID NO: 24568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgattttaacggtttcaattccatctagc

SEQ ID NO: 24569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcacacaggggattgagtgtttcctagg

SEQ ID NO: 24570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcacgggtaacgctgaaacgaggagacc

SEQ ID NO: 24571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcactccttgcactacctagctcgcttt

SEQ ID NO: 24572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcacttgagttaagaggtttaaagattg

SEQ ID NO: 24573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcatcgcgctttggcggccaagtacgcg

SEQ ID NO: 24574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcatttgtggtaagcaacgctgcagtga

SEQ ID NO: 24575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccagacacgacgctacggttgtgggat

SEQ ID NO: 24576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccccgcgatagatgttatcggaattat

SEQ ID NO: 24577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccgaacagggcgccagacagggcagat

SEQ ID NO: 24578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccgagcgctagtattcaacgagacggg

SEQ ID NO: 24579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccgcaaggggaaattgtttttgggcac

SEQ ID NO: 24580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgccgggcaggcttgtaaacgggttcagt

SEQ ID NO: 24581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcctgacatgtcattaatgcagtatttc

SEQ ID NO: 24582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcgagggtttcatgtacagttgctctgg

SEQ ID NO: 24583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcgagttaatcgtaaggggtaggggtta

SEQ ID NO: 24584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcgctgttaattcggatcttaaagactc

SEQ ID NO: 24585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcggcaaccggtcatcgtaagggtcctg

SEQ ID NO: 24586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcgtgccccattaaccggtgacgcctct

SEQ ID NO: 24587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcgttcacaggctctgtaggcctgatca

SEQ ID NO: 24588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgctagcctcctgtggtgcgttagtgcgg

SEQ ID NO: 24589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgctagtccctggtgcttggtgtgattct

SEQ ID NO: 24590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgctcagtttgttgatgttacaccgcctt

SEQ ID NO: 24591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgctcggtcgggaagtttttactgttcta

SEQ ID NO: 24592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgctcggttattctccatcgtaattgtcc

SEQ ID NO: 24593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcttatgactgaatcgtggtgatggccg

SEQ ID NO: 24594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcttgcattgtcggtgaagaccctgggt

SEQ ID NO: 24595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgcttttagctgacccgattgttaagcca

SEQ ID NO: 24596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggaatcaagagacttttaggacaagtag

SEQ ID NO: 24597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggaatcggacggatgcatgccggtgccg

SEQ ID NO: 24598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggacaagaattcaccgcacctcgagatt

SEQ ID NO: 24599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggaccaacgggaggtcttgcacggcagg

SEQ ID NO: 24600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggagcggtcggtgctaagtcgctatttt

SEQ ID NO: 24601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggagtttgcaccgatgacgtcatgcaat

SEQ ID NO: 24602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggatggcgttttgacggctagtggcatg

SEQ ID NO: 24603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggattttgtcaagttcgtactggctgag

SEQ ID NO: 24604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggcataaagcatgtagtcttaatcccgt

SEQ ID NO: 24605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggcatagtcgcggctgcaaaacgtaggg

SEQ ID NO: 24606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggccccggcgacctgcacttggtgttac

SEQ ID NO: 24607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggcgaccgtcacagtcggtagtgtcata

SEQ ID NO: 24608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggcgcaggagagcgattacggtgtgtcg

SEQ ID NO: 24609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggcgttagatgctcactcgaatgttgcg

SEQ ID NO: 24610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggctaggctagcaaggcctatgccgctt

SEQ ID NO: 24611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggctcccgcgccagatcaccggcgtcct

SEQ ID NO: 24612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggctccgatgaggtgctaacggtctgcg

SEQ ID NO: 24613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggcaacggtcaagcggaacttacagcg

SEQ ID NO: 24614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggctagagttgcttccgacgcgtaccg

SEQ ID NO: 24615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggggttcgttttcaagagtagtttatc

SEQ ID NO: 24616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggtcctgtccccccctagaagtactac

SEQ ID NO: 24617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggtttccacagctgagtggtctcagca

SEQ ID NO: 24618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgggttttttttgcagtgtattatagatc

SEQ ID NO: 24619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggtcatcgtcgtcggggaaggtcttgtg

SEQ ID NO: 24620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggtccacagattgcgctggctagccccc

SEQ ID NO: 24621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggtgcttgattccgcgtccggcgtcctt

SEQ ID NO: 24622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggtgtgaaaggcagacgtcgatctggtc

SEQ ID NO: 24623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcggtttcggcaagcgatcggctaacggtt

SEQ ID NO: 24624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtaaccatgcgtcataatgtgcggccgc

SEQ ID NO: 24625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtaccggcaaattttggatggtggttct

SEQ ID NO: 24626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtagaaagcctgggcgtgcgactcctaa

SEQ ID NO: 24627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtagcctgttgattcgagtgttgccttt

SEQ ID NO: 24628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtatgacacaggacatctgactaacggt

SEQ ID NO: 24629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtatttgtcagtgcagggtctttaccgc

SEQ ID NO: 24630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtccagtccggtctacacgttatacagg

SEQ ID NO: 24631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtcgacataccatccggatactcttgtg

SEQ ID NO: 24632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtcgcagtcaagtctttacggctggtgg

SEQ ID NO: 24633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtcggggcgtcgcagcatcctagcacgt

SEQ ID NO: 24634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtctaggtggaagcgccaggttggttgc

SEQ ID NO: 24635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtctccgaaccccgttcttgttcagatg

SEQ ID NO: 24636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtcttgtcgtttattgtgatcactcatg

SEQ ID NO: 24637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgcagttcatgacgcagctagacgtgg

SEQ ID NO: 24638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgcatgttttggctccgcgctgagttg

SEQ ID NO: 24639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgccatctagcatgcttcggggtactc

SEQ ID NO: 24640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgcccacttggactgttgatcctgctt

SEQ ID NO: 24641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgcgctaagtcatgctcggcgtattta

SEQ ID NO: 24642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtgcttaatgatatttaggactgttgcc

SEQ ID NO: 24643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtggaggtgattcacgtggcttctgctg

SEQ ID NO: 24644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtggctagctcgctcttgagatgctgtc

SEQ ID NO: 24645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtggtttgtagctgcttatttccttgcc

SEQ ID NO: 24646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttagggatacatcggggacctactgtt

SEQ ID NO: 24647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttcccgtcgcctgtgtctatggtgcgt

SEQ ID NO: 24648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttctatgcctggtctcttgtaaccctg

SEQ ID NO: 24649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgacaatgtacgacacctacccgtcc

SEQ ID NO: 24650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgatcaggtttgtaccagataggtcg

SEQ ID NO: 24651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgatctgcggggttagtcatataagc

SEQ ID NO: 24652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgcgacaggttatatctgatcactag

SEQ ID NO: 24653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgcgctgctcgagaatttgctggcgg

SEQ ID NO: 24654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttggagaaggggtgccgggtattggct

SEQ ID NO: 24655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttgtaagtcttctcgttctgtacctca

SEQ ID NO: 24656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtttatatagaggcaatcttcgttcatc

SEQ ID NO: 24657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtttgccctccaagtacactcctcggcc

SEQ ID NO: 24658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgtttgtgatccgcgcgaatatgattatc

SEQ ID NO: 24659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcgttttgttactcgcaatgctttaaatgg

SEQ ID NO: 24660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctaattcttctcgttaggggccctggctt

SEQ ID NO: 24661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctacactgccgtactgtaaatcggaaccc

SEQ ID NO: 24662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctaccgcagttcggttttcagtccttcgt

SEQ ID NO: 24663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctacggtaacactaacgtttccacgcgct

SEQ ID NO: 24664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctaggatgccgcgatagggaccatctgga

SEQ ID NO: 24665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctagtttacattatctcgggctctcgagc

SEQ ID NO: 24666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctatgctggtatacgctatgctgatgccg

SEQ ID NO: 24667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcacctgcacaggcatttgcagggagta

SEQ ID NO: 24668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcacgctgattgggccacagtacggcat

SEQ ID NO: 24669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcactcagatccaatgtatggcgctata

SEQ ID NO: 24670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcaggtctgggctgcctacctccaccgg

SEQ ID NO: 24671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcatatgttacccagtatgtcttgcgca

SEQ ID NO: 24672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcatgctcgcccgtcccccgcctctgtg

SEQ ID NO: 24673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctccctgacgtgtttatacatttattggg

SEQ ID NO: 24674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctccgccctgatagaacctggtcgcaatg

SEQ ID NO: 24675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctccgtcatcgtggctatgggaacgcaag

SEQ ID NO: 24676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctccgtctcgtaaaatcattgcggggagt

SEQ ID NO: 24677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcctacttgcgatccaggtcttcaggcc

SEQ ID NO: 24678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgaaaaagttgcctcacggtaacgcat

SEQ ID NO: 24679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgcggcacgggaggaccgtcgtgctcg

SEQ ID NO: 24680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgcgtagacacagacgtgttcggctgg

SEQ ID NO: 24681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgtatgttcactgttcctggtattcta

SEQ ID NO: 24682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgtccactacaatccacgcataaggct

SEQ ID NO: 24683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgtgagcctgcgagcacagacacggct

SEQ ID NO: 24684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcgtgggggcaccaggctctcaacttca

SEQ ID NO: 24685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctctactacgttcgtttggcgcatctccg

SEQ ID NO: 24686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctctcgcataacgtttaatcatgtctgga

SEQ ID NO: 24687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctctgggaagacggttcattcttgcgcga

SEQ ID NO: 24688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctcttacctgtgaccatgcaggtttacct

SEQ ID NO: 24689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgaaatcgtcgcatgatgctcggcggca

SEQ ID NO: 24690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgaacgatatcgcgggccgaagttccgc

SEQ ID NO: 24691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgaagtccggggaatgaacgcctcgggc

SEQ ID NO: 24692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgacgatggcccgcgatgagctcgaatt

SEQ ID NO: 24693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgagcccatgatgcattttggttgccgt

SEQ ID NO: 24694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgagcgcctggacatgttctatggaggc

SEQ ID NO: 24695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgatgtcgggagtgcaacaccttttgta

SEQ ID NO: 24696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcaaccctggacccacctgttggagcc

SEQ ID NO: 24697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcactcgtagggggagcatcatgggct

SEQ ID NO: 24698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcccatacttcttcccgtaacttggcc

SEQ ID NO: 24699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcgggatcggctcgcgttgctttcggc

SEQ ID NO: 24700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcggtccgggctgactaaggattttac

SEQ ID NO: 24701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgcgtactgagtgagactagatgctttg

SEQ ID NO: 24702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgctggcggagccagggaacattgcccg

SEQ ID NO: 24703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctggaagattaacgttactcccctactgc

SEQ ID NO: 24704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctggatatctcgcttccagctcttagttc

SEQ ID NO: 24705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgggttagatgatcggcgccgtaatgtc

SEQ ID NO: 24706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctggtgacacctgagtgagctgctcgggg

SEQ ID NO: 24707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgtaaactggtcgcgctggctagctgtg

SEQ ID NO: 24708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgtatttgcacggctatcttacgctgcc

SEQ ID NO: 24709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgtgtggatgttcccgtctagccaggtg

SEQ ID NO: 24710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgtgttggtaatatctcctgggcatgat

SEQ ID NO: 24711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgttctcgcccccctggtaatgcttctc

SEQ ID NO: 24712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctgtttggccaagctgtccggctgtgaat

SEQ ID NO: 24713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttaaccttttgcctttcagaagctcaac

SEQ ID NO: 24714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttacaaccgacataaagaaaacacctgt

SEQ ID NO: 24715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttacgtaactggatccccgcttaaattt

SEQ ID NO: 24716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttactgattccgctctggtgggttacgc

SEQ ID NO: 24717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttagaacttggacctgaccagtttctac

SEQ ID NO: 24718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttcgatttggtatacgtgggagcttcac

SEQ ID NO: 24719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttcggattcgatccggattcggttacct

SEQ ID NO: 24720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttctaactaacaactcgcgccaacctct

SEQ ID NO: 24721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttctgcatctgttcaggagaacctttac

SEQ ID NO: 24722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttctggttgtaattttgagggtccggga

SEQ ID NO: 24723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttctttagatctcgccccgttcgccttc

SEQ ID NO: 24724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgaatctccacgttcggcaggccggca

SEQ ID NO: 24725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgattgtgacccgcacttaagcgtctg

SEQ ID NO: 24726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgcaacctcggccgttggcatgagccc

SEQ ID NO: 24727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgcaacggtacacgccagcgcccgcgg

SEQ ID NO: 24728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgccagacacagaacggttaggctgga

SEQ ID NO: 24729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgccatgtgcctgcctccctcgtagca

SEQ ID NO: 24730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgcgtgcggtcatcaaggtctgtggcg

SEQ ID NO: 24731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgctcggattagctagcttctctatag

SEQ ID NO: 24732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttggggagttcaacgcgtccagtggcga

SEQ ID NO: 24733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttggggcggtatgcgttaatggctataa

SEQ ID NO: 24734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgggtagctcggtaggcgctggtgatc

SEQ ID NO: 24735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttggtgcttgtatcggtatgcgcgggcg

SEQ ID NO: 24736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctcttgtagtcggaccagtgtcagacggcct

SEQ ID NO: 24737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctttattgtcggttgaacactgatggata

SEQ ID NO: 24738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctttgactagaattgggcatggacttgta

SEQ ID NO: 24739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctctttgcgcttaaagcagctactggtctca

SEQ ID NO: 24740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaaaacgttctgactgcaaccaacgcatg

SEQ ID NO: 24741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaaagccttgcaggattcacgtgcattgc

SEQ ID NO: 24742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaaagctacctgcaggtagcgcaccgcgg

SEQ ID NO: 24743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaaatatttgggaaaagtaggttgcgtta

SEQ ID NO: 24744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacacactgggagagcattgttaatatc

SEQ ID NO: 24745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacacatggagcccatcccgttatacgt

SEQ ID NO: 24746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaaccttagcgaggccttcatgtcggagg

SEQ ID NO: 24747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacgcggagcttatggggacgttcatag

SEQ ID NO: 24748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacgctggtacccaaagagagatactgg

SEQ ID NO: 24749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacggactaatcttttaggcgggtattg

SEQ ID NO: 24750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaactggggcgtgtcccgacctgcccatg

SEQ ID NO: 24751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaacttaaacttgggtcgtcggcacgctg

SEQ ID NO: 24752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagatgccgctactcgggcaagctgggc

SEQ ID NO: 24753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagccgtgtctggatcacgtcgtcgtcc

SEQ ID NO: 24754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagctgttgggacttgtttcggcacgcc

SEQ ID NO: 24755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagggcagggcgcgcaggtggtacagtg

SEQ ID NO: 24756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagtccccgcaagccgtgatacgttcga

SEQ ID NO: 24757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaagtccgccacctatcctggatccagta

SEQ ID NO: 24758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaatccttacacgggaaactacgggctac

SEQ ID NO: 24759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaatctgaagcagacaactttactggctc

SEQ ID NO: 24760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaatgctgggaccgtgtatcgttggcttc

SEQ ID NO: 24761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaatgtgccctcatgaccccctgcttgaa

SEQ ID NO: 24762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacaagcagttggacctaggatcttctat

SEQ ID NO: 24763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacacgcgtgatcatgcactaaattcggc

SEQ ID NO: 24764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacactgcagcgcgaggttttggtcttgt

SEQ ID NO: 24765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacagtacgagttacgagtactttcccca

SEQ ID NO: 24766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacagtgatcactaacgcacaaggacgca

SEQ ID NO: 24767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaccatgttatatatagatcagctctcct

SEQ ID NO: 24768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaccggggcagatctaatgtgcctgtacc

SEQ ID NO: 24769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacctgcatattctattaacggaaggcga

SEQ ID NO: 24770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaccttatttgttcggccgtatacggttg

SEQ ID NO: 24771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacgatagctcagcgtttgaggcttctgc

SEQ ID NO: 24772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacgcgatcttggagccttgattcgttaa

SEQ ID NO: 24773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacggattgggacatagtttggtggcctg

SEQ ID NO: 24774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacgtacttgagtacagcccttgacttat

SEQ ID NO: 24775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacgtgaaaacaatatttctagcttggta

SEQ ID NO: 24776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactaaaccggtgatagcaagtcttagct

SEQ ID NO: 24777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactagtaggccaattacgatctgctagc

SEQ ID NO: 24778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactcacatgccgctggcggttctgtgac

SEQ ID NO: 24779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactcttgtttcgcaccagcatggattat

SEQ ID NO: 24780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactgaatagttaaggctagcaattagtg

SEQ ID NO: 24781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactgagaggtcgccgcttgcagtgcctg

SEQ ID NO: 24782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgactgtgcgaagagaccaccgcgccctaa

SEQ ID NO: 24783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgacttagcgggtgctcaatccgccatcgt

SEQ ID NO: 24784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagaatgtcgctctacccttaaagctcat

SEQ ID NO: 24785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagacgggaggatgctgatcattggtgcc

SEQ ID NO: 24786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagcaacgcgcaccgaggtggaggggctg

SEQ ID NO: 24787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagcactaacgcgttgggatcgtgtcatg

SEQ ID NO: 24788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagccagtgaggggtagcggttaggcgag

SEQ ID NO: 24789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagccggtgagctttcgtgaaggttgttc

SEQ ID NO: 24790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagctcagatttccccatcaattggcgta

SEQ ID NO: 24791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaggagcgcaaacgtcgatagtggctagc

SEQ ID NO: 24792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaggcagtgttgttccctctgcgtgctgt

SEQ ID NO: 24793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaggctggagtcttcaggtgctaagtggg

SEQ ID NO: 24794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagggattcacccgccagtacccctcccc

SEQ ID NO: 24795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaggtcaacataggacggacttgcgtgcc

SEQ ID NO: 24796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgaggttgcgcgtcacctgagttccgagct

SEQ ID NO: 24797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagtcttacgatctcgacgaacagcattc

SEQ ID NO: 24798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagtgtaagggaatttggtcggcggggtt

SEQ ID NO: 24799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagtgtaagtcccccagcgcctgtccacc

SEQ ID NO: 24800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagtgtcagcggactgctcctatgggtat

SEQ ID NO: 24801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagttgcgggcccaatctacccggccggc

SEQ ID NO: 24802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgagttggcaaagtgcacagttgacgttca

SEQ ID NO: 24803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgataacaaataatttacctgctaaacagt

SEQ ID NO: 24804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgataatgattttgttatccagccagggga

SEQ ID NO: 24805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatagattggattcataccgccggattca

SEQ ID NO: 24806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatatctggaaaaaacacttggtatttgc

SEQ ID NO: 24807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatcccggttccagagcgtttaatgtttt

SEQ ID NO: 24808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatcctcatttctggctgtataactctcg

SEQ ID NO: 24809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatcgcgttaaggtacttggttggtctag

SEQ ID NO: 24810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatctgaggaaaggggagtatgcggtgaa

SEQ ID NO: 24811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgaacacactgttaccttggtatccgc

SEQ ID NO: 24812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgaagcgacaagtatcttgctttgttc

SEQ ID NO: 24813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgattggggagttcgacggataagggc

SEQ ID NO: 24814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgcaaccaccgatttgtggcaaacgtt

SEQ ID NO: 24815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgctgatcttaactgactatatacgtg

SEQ ID NO: 24816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatggattccataggacaatgataaccgt

SEQ ID NO: 24817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatggttccgatttatactcagcgtcgtg

SEQ ID NO: 24818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatgtcatttcggacggaaacgagagccg

SEQ ID NO: 24819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattaaatcacgtaccgagcaacacgcct

SEQ ID NO: 24820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattagatcatgctggacccatgcggctc

SEQ ID NO: 24821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattcgcgcacttggctcgggaactgacg

SEQ ID NO: 24822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattctggcgttggttttaagtgaggtca

SEQ ID NO: 24823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattgacacccacacatctgatgacctcg

SEQ ID NO: 24824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattgaggccaactgctttagagaaaagc

SEQ ID NO: 24825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgattgggggtagagcctgatttctgatga

SEQ ID NO: 24826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgatttatccccgcccgtgttcagaaggct

SEQ ID NO: 24827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcaaccggagggacggcttcctcttggtt

SEQ ID NO: 24828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcacatcccacgcggtgtaagcagtttcg

SEQ ID NO: 24829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcaccacttcaactctttgcgatcccggt

SEQ ID NO: 24830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcacgagaaatgtgcttcgctcgttggcg

SEQ ID NO: 24831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcacgatatcgccgggtaccgtacgcgaa

SEQ ID NO: 24832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcacgcggaacaaacgcagaggccaacca

SEQ ID NO: 24833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcacggtgtcatacgcaacagcattggcg

SEQ ID NO: 24834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcactcgggtcgtccaactgctggatggt

SEQ ID NO: 24835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcaggcggatgcacgggaggatgagggac

SEQ ID NO: 24836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcaggtcgagtgggcgacaatgcgagggc

SEQ ID NO: 24837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcagtaataattgcatgtaagctcatctc

SEQ ID NO: 24838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcagtacacagttgtcaaagaagcgcgct

SEQ ID NO: 24839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcagtctaattgcttcggcgctatgtgct

SEQ ID NO: 24840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcagtctgggtacgctcgacgccctaacg

SEQ ID NO: 24841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcagtgtattggcagatcgctgtattgct

SEQ ID NO: 24842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatacaaattgagagcggatgattaggt

SEQ ID NO: 24843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcataggttaccagtttggcgggtgggga

SEQ ID NO: 24844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatatcacggcttaacaggactggctca

SEQ ID NO: 24845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatcctggacaggcaaacttgtgccgat

SEQ ID NO: 24846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatcggtagcgagtggcacgtttccctg

SEQ ID NO: 24847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatgaaagcgcggtcgcctactttttct

SEQ ID NO: 24848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatgagacatgggcttgactggtagcgc

SEQ ID NO: 24849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatgcaacctcggtcctgtttctctgcc

SEQ ID NO: 24850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcatggccgcacgattagtctccctcgcc

SEQ ID NO: 24851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcattgggccgccgttggcgagtctcggt

SEQ ID NO: 24852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccaaaatttgtcgggtttgttggatgtt

SEQ ID NO: 24853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccaactgtctcgcaggtcgggatgtacg

SEQ ID NO: 24854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccaagccctcagcgccacagtaagttgg

SEQ ID NO: 24855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccaataggaacggaacgctgcctgtggg

SEQ ID NO: 24856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccaccgctagacctacttgtaatttggt

SEQ ID NO: 24857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccagatcgggggacagatgtctcaaagc

SEQ ID NO: 24858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccagcatcccagtcccgcttcggatcgc

SEQ ID NO: 24859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccagcattatcacggttagggaaggtcc

SEQ ID NO: 24860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccagcgataccgtatcacgcctgtcacg

SEQ ID NO: 24861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccagctcaccgatagacctagacgtagt

SEQ ID NO: 24862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccatcattcctatgtctatatcggggtg

SEQ ID NO: 24863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccatgcgtcctttgtttgtgctcactgc

SEQ ID NO: 24864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccacactgcccgctcactgactatcgc

SEQ ID NO: 24865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccatcgcgtttgcctcattcgcgtaac

SEQ ID NO: 24866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccccgccatagtactcccaccgtgcgtg

SEQ ID NO: 24867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccctacttgctcactcacggatcgttt

SEQ ID NO: 24868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccggcgtttggtgtacttgtcgcgtac

SEQ ID NO: 24869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccggtatactacggtagctgagtcccg

SEQ ID NO: 24870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcccgttacttggctgttgcacgggaatt

SEQ ID NO: 24871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccctcgcgcgtggcagagagcttcgacg

SEQ ID NO: 24872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgaggggtaggactgcggcgcgcgtga

SEQ ID NO: 24873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgcgctgcgacgaattctgtggcgcga

SEQ ID NO: 24874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgcggctgcctggacggttcctcgctc

SEQ ID NO: 24875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgcgggatagacaactgtgccggcccg

SEQ ID NO: 24876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgggaacgcaactctaatttaccgccc

SEQ ID NO: 24877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccgtgtcccatgacaattggcaagcctg

SEQ ID NO: 24878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcctgtgctcttgttaaaggtaatagtcc

SEQ ID NO: 24879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccttagggggcccgcttcgcttccacga

SEQ ID NO: 24880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccttcgagggttaacttaatgcttatct

SEQ ID NO: 24881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccttcgtggttgtcacagctccctgtcc

SEQ ID NO: 24882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccttgccaaagttagtttcccaggttgt

SEQ ID NO: 24883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgccttgttttactgaaagtttttggttaa

SEQ ID NO: 24884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgaatgttgtacctcgacgcacttaagg

SEQ ID NO: 24885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgacgcacgcatcgtaacccgaaaccgg

SEQ ID NO: 24886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgactgcattggtgaaatcttaagggtt

SEQ ID NO: 24887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgacttatccgcatgacagtctcggccc

SEQ ID NO: 24888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgagatgaattgtttacgggtttgttcg

SEQ ID NO: 24889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgaggcacgagcaccggaacatggttta

SEQ ID NO: 24890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgagtacaatagcttttgttagaacgtg

SEQ ID NO: 24891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgatttgcgtgacgggggcagctagtcg

SEQ ID NO: 24892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcagaagttgagtagccctcggccaca

SEQ ID NO: 24893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcagagtcacataaggtttgttacggc

SEQ ID NO: 24894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcaggctttagcgtctccttttagcgg

SEQ ID NO: 24895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcccggattccacacgcgtgttccccc

SEQ ID NO: 24896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcgaccggtggagaatgtcgtggatcg

SEQ ID NO: 24897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcgcgttcactccggaggtgtgacgta

SEQ ID NO: 24898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgctcggtcttagtgctgttaaaagatc

SEQ ID NO: 24899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgcttcggagttcgatatcggcacgatg

SEQ ID NO: 24900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcggcaaccatggtttctcagggcagaaa

SEQ ID NO: 24901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgggaaatgcgtccaagcggtatggctt

SEQ ID NO: 24902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtagtcagtgagttgatccaccttccc

SEQ ID NO: 24903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtatcattccctaaaacacgttctggc

SEQ ID NO: 24904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtcatcgtcaacgtgaagttaacactc

SEQ ID NO: 24905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtcgacagggttatcgtcgtgcttttg

SEQ ID NO: 24906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtctaccatacccgatcactcgccagc

SEQ ID NO: 24907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtgatgggcaatgggtgcgcgccgggg

SEQ ID NO: 24908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtgcctctgcctatcgggctgaccaag

SEQ ID NO: 24909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtgtccaacagtcattttaacgtgtgg

SEQ ID NO: 24910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtttatgacgatgtctgctctcgtcct

SEQ ID NO: 24911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcgtttgatgacgagcggatggaccggtc

SEQ ID NO: 24912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctaactgggaccagagcaccaagggccg

SEQ ID NO: 24913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctaattgaccgtgtagtacctgtatggc

SEQ ID NO: 24914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctactctgagtggggacccgtgtcgctg

SEQ ID NO: 24915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctagaggaaggagcgggcgggtactcct

SEQ ID NO: 24916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctagtcgcgggggatgagttcgggtcta

SEQ ID NO: 24917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcaaagtacgatgatggaagttatagt

SEQ ID NO: 24918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcaaggaatggttcttcagcggaggcg

SEQ ID NO: 24919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcacagacgtcagtctatttcgatccg

SEQ ID NO: 24920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcacagcctcaactgtttatattcatc

SEQ ID NO: 24921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcagcgtggcgccacgcattaaacagc

SEQ ID NO: 24922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctccatcaactttcgcatctatagggcc

SEQ ID NO: 24923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctccttgtgcccatgctcatgattgcgg

SEQ ID NO: 24924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctcggtattgtatcgaaacactcagggg

SEQ ID NO: 24925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgaaccacgtttgcgcgtggaacacct

SEQ ID NO: 24926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgaattgcgttctagtcatcgcgaggg

SEQ ID NO: 24927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgaattggggaggtgtccagcctcgcg

SEQ ID NO: 24928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgaccgtatggttatttgggacactag

SEQ ID NO: 24929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgatacacaggaccgttgagttatcac

SEQ ID NO: 24930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctgcggttgaaggtgcggagtctggaga

SEQ ID NO: 24931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctggcaccacttgatcccctggagctgt

SEQ ID NO: 24932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctggcgatgtggaaacagggccttccgt

SEQ ID NO: 24933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctggggtgggcaacagggtgcagtccgg

SEQ ID NO: 24934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttacgtgtagatggatgctcctctgga

SEQ ID NO: 24935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttactttgcttcgggcgtggctggatt

SEQ ID NO: 24936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttagccggttattgtgttcgatgaagt

SEQ ID NO: 24937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttcggcattgatgtaccgtaggagtgt

SEQ ID NO: 24938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttgataaagttagctctaatcgatctc

SEQ ID NO: 24939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttgcctcaaccccggcggcccacggtc

SEQ ID NO: 24940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgcttgtttctgccagctgcaagtgtgcat

SEQ ID NO: 24941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctttaaatcgtgccgtgtttcgtgaact

SEQ ID NO: 24942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctttcgagcggtaggtggatatatgtgt

SEQ ID NO: 24943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgctttgtgacgtgaaagcgcgagaagacg

SEQ ID NO: 24944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaaatgcactgctaacggccaggaggaa

SEQ ID NO: 24945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaatcatggaaggtggtgctcgcgaata

SEQ ID NO: 24946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaatctcttggtaacgtgcgttcgtggt

SEQ ID NO: 24947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggacacattgaaatgacggacagtgggga

SEQ ID NO: 24948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggacagtggggtttgctgttagatttcca

SEQ ID NO: 24949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaccaggtctccgtggtgcgtgcgcttc

SEQ ID NO: 24950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaccgcagaatcgcgcattttcagcgag

SEQ ID NO: 24951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggacctgttgttaccgccaaaagatcgcg

SEQ ID NO: 24952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggacgattctttggttctcatccgtcggc

SEQ ID NO: 24953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggacgtggttcgctggatgacctggaagt

SEQ ID NO: 24954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggagaggtagttcctcgccgcacgcacct

SEQ ID NO: 24955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggagcttgaaccaccttgatctgacaagg

SEQ ID NO: 24956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaggaggactaagagcaggcgtagtttg

SEQ ID NO: 24957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaggtcatgagcaaggagaggcgggtgg

SEQ ID NO: 24958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggaggttacaagaatattggtacttcgag

SEQ ID NO: 24959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggagtttcgaacaagtggctaggcatgtc

SEQ ID NO: 24960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggagtttgtcaacgagattatggcaggac

SEQ ID NO: 24961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggatacgccggctctacacgtagcgtctt

SEQ ID NO: 24962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggatacttattaatttgtctcggatgcgt

SEQ ID NO: 24963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggatcatgccgtgccacattcgcggacgt

SEQ ID NO: 24964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggatccaccacgtctaccgcgtccgggat

SEQ ID NO: 24965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggattttctttttggaactgagtcgtagg

SEQ ID NO: 24966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaaacgtcgagtagtaaccgggtagga

SEQ ID NO: 24967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaacttccacacctcagacttggcata

SEQ ID NO: 24968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaaggacgtgattccgattgtggtgcc

SEQ ID NO: 24969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaatagggggcccgtgtggggcgtcga

SEQ ID NO: 24970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcacatctgtgaacacgtgtatccggga

SEQ ID NO: 24971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaccaatttggctgttgcggggtggat

SEQ ID NO: 24972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcacgcacgtgatcattgtgctcagggt

SEQ ID NO: 24973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcactcaatccgtactacaaagggtcgg

SEQ ID NO: 24974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcactcgagtacgctcacccaactcgct

SEQ ID NO: 24975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcagaaggcactcggacctctccgtagc

SEQ ID NO: 24976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcagacacccatctggacccgtacgctc

SEQ ID NO: 24977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcaggggagtgcactctcgttccatctg

SEQ ID NO: 24978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcatacagctattccgtttgtgtaccgt

SEQ ID NO: 24979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcatcggcatcggtcgaacaagttacgc

SEQ ID NO: 24980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcatgcaggcagaatgcaaatcgcgtat

SEQ ID NO: 24981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcattagaagatcaagttctacgggctg

SEQ ID NO: 24982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggccaggggcagtgattggtggcctcaac

SEQ ID NO: 24983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcccactcgggaatcccgccgacggtgg

SEQ ID NO: 24984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggccctctggcggcacaattctgcccagt

SEQ ID NO: 24985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggccgaattggtccaagctgcgtgggcga

SEQ ID NO: 24986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggccggcaatcggttcccacgtctgtgcg

SEQ ID NO: 24987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcgaattgggtacttcgttcagcggctc
